United States Patent
Wessjohann et al.

(10) Patent No.: US 10,988,786 B2
(45) Date of Patent: Apr. 27, 2021

(54) MUTANT 4-HYDROXYPHENYLACETATE 3-HYDROXYLASES AND USES THEREOF

(71) Applicants: SYMRISE AG, Holzminden (DE); LEIBNIZ-INSTITUT FÜR PFLANZENBIOCHEMIE, Halle (DE)

(72) Inventors: Ludger A. Wessjohann, Halle (DE); Susann Herrmann, Halle (DE); Martin Dippe, Halle (DE); Torsten Geissler, Einbeck (DE); Katrin Geissler, Einbeck (DE); Jakob Peter Ley, Holzminden (DE)

(73) Assignees: SYMRISE AG, Holzminden (DE); LEIBNIZ-INSTITUT FÜR PFLANZENBIOCHEMIE, Halle (DE)

(*) Notice: Subject to any disclaimer, the term of this patent is extended or adjusted under 35 U.S.C. 154(b) by 206 days.

(21) Appl. No.: 15/764,644

(22) PCT Filed: Sep. 30, 2016

(86) PCT No.: PCT/EP2016/073456
§ 371 (c)(1),
(2) Date: Mar. 29, 2018

(87) PCT Pub. No.: WO2017/055573
PCT Pub. Date: Apr. 6, 2017

(65) Prior Publication Data
US 2019/0194707 A1   Jun. 27, 2019

(30) Foreign Application Priority Data

Oct. 2, 2015 (EP) ..................................... 15188136

(51) Int. Cl.
| | | |
|---|---|---|
| *C12P 17/06* | (2006.01) | |
| *C12N 9/02* | (2006.01) | |
| *C12N 9/10* | (2006.01) | |
| *C12P 7/22* | (2006.01) | |
| *C12P 7/26* | (2006.01) | |
| *C12P 7/42* | (2006.01) | |
| *C12P 17/10* | (2006.01) | |

(52) U.S. Cl.
CPC ............ *C12P 17/06* (2013.01); *C12N 9/0071* (2013.01); *C12N 9/1007* (2013.01); *C12P 7/22* (2013.01); *C12P 7/26* (2013.01); *C12P 7/42* (2013.01); *C12P 17/10* (2013.01); *C12Y 114/14001* (2013.01); *C12Y 201/01* (2013.01)

(58) Field of Classification Search
None
See application file for complete search history.

(56) References Cited

U.S. PATENT DOCUMENTS

2014/0363858 A1* 12/2014 Yan ..................... C12N 9/0071
                                                              435/125

OTHER PUBLICATIONS

Bornscheuer et al. Curr Protoc Protein Sci. Nov. 2011;Chapter 26:Unit26.7. (Year: 2011).*
Yoshikuni et al. Curr Opin Chem Biol. Apr. 2007;11(2):233-9. (Year: 2007).*
Dhammaraj et al. ACS Catalysis 2015, 5, 8, 4492-4502. Publication Date (Web):Jun. 24, 2015 (Year: 2015).*
Xun et al. Appl Environ Microbiol. Feb. 2000; 66(2): 481-486 (Year: 2000).*
Chica et al. Curr Opin Biotechnol. Aug. 2005;16(4):378-84. (Year: 2005).*
Singh et al. Curr Protein Pept Sci. 2017, 18, 1-11 (Year: 2017).*
European Office Action dated Jul. 12, 2019, for corresponding EP Application No. 15188136.4-1132.
Kabumoto, Hiroki et al., "Directed Evolution of the Actinomycete Cytochrome P450 MoxA (CYP105) for Enhanced Activity," Bioscience, Biotechnology, and Biochemistry, vol. 73, No. 9, 2009, pp. 1922-1927.
Kasai, Noriyuki et al., "Enzymatic properties of cytochrome P450 catalyzing 3'-hydroxylation of naringenin from the white-rot fungus *Phanerochaete chrysosporium*," Biochemical and Biophysical Research Communications, vol. 387, No. 1, 2009, pp. 103-108.
Kitamura, Emi et al., "Production of Hydroxlated Flavonoids with Cytochrome P450 BM3 Variant F87V and Their Antioxidative Activities," Bioscience, Biotechnology, and Biochemistry, vol. 77, No. 6, 2013, pp. 1340-1343.
Lee, Yoon Jung et al., "Biotransformation of Flavonoids with O-Methyltransferase from Bacillus cereus," Journal of Microbiology and Biotechnology, vol. 16, No. 7, 2006, pp. 1090-1096.
International Search Report and Written Opinion dated Jan. 27, 2017 in the PCT Application No. PCT/EP2016/073456.

* cited by examiner

*Primary Examiner* — Christian L Fronda
(74) *Attorney, Agent, or Firm* — Polsinelli PC

(57) ABSTRACT

The present invention relates to genetically modified enzymes obtained by rational design of the active site binding pocket of the prototypic enzyme 4-hydroxyphenylacetate 3-hydroxylase (4HPA3H) for hydroxylating a 4-hydroxyphenyl compound to yield a 3,4-dihydroxyphenyl compound and to biotechnological methods including in vivo and in vitro methods using said enzymes or catalytically active fragments thereof. Further provided is a method either using a suitable oxidase or hydroxylase further enabling the subsequent site specific methylation of the 3,4-dihydroxyphenyl compound in a coupled enzymatic reaction by providing a suitable O-methyltransferase. Finally, compositions obtainable by the aforementioned methods are disclosed.

10 Claims, 13 Drawing Sheets

Specification includes a Sequence Listing.

MUTANT 4-HYDROXYPHENYLACETATE 3-HYDROXYLASES AND USES THEREOF

CROSS-REFERENCE TO RELATED APPLICATIONS

This application is a national stage application (under 35 U.S.C. § 371) of PCT/EP2016/073456, filed Sep. 30, 2016, which claims benefit of European Application No. 15188136.4, filed Oct. 2, 2015, which are incorporated herein by reference in their entireties.

SEQUENCE LISTING SUBMISSION VIA EFS-WEB

A computer readable text file, entitled "085158-589430 Amended Sequence Listing.txt", created on or about Jul. 11, 2018, with a file size of about 651 KB contains the sequence listing for this application and is hereby incorporated by reference in its entirety.

TECHNICAL FIELD

The present invention relates to biotechnological methods genetically modified enzymes or catalytically active fragments thereof possessing optimized substrate tolerance and high region—and product specificity obtained by rational optimization of the active site binding pocket of the prototypic enzyme 4-hydroxyphenylacetate 3-hydroxylase (4HPA3H) for hydroxylating a 4-hydroxyphenyl compound to yield a 3,4-dihydroxyphenyl compound. Further provided is a method coupled to the aforementioned method either using a suitable oxidase or hydroxylase and further enabling the subsequent site specific methylation of the 3,4-dihydroxyphenyl compound in a coupled enzymatic reaction by providing a suitable O-methyltransferase. Suitable nucleic acid and amino acid sequences, vectors, and recombinant host cells for conducting the above methods are provided. Finally, compositions are provided which can be obtained according to one method provided herein.

BACKGROUND OF THE INVENTION 3,4-dihydroxyphenyl compounds, e.g. caffeic acid, piceatannol, eriodictyol, 3,4-dihydroxybenzoic acid and esculetin are precious natural products having inter alia antioxidative properties, e.g., by scavenging harmful oxygen species. Further favorable characteristics including a variety of health benefits including anti-inflammatory or anti-cancer activities are attributed to said class of compounds. Said substances, however, only occur in very low concentrations in plants suitable for food products. This especially applies for eriodictyol or its glycosides eriocitrin and neoeriocitrin present in plants of the genus Citrus. Eriodictyol (cf. FIG. 1 and FIG. 13) is a well-known flavoring substance which is suitable to effectively reduce and mask the bitter impression or taste of a variety of bitter constituents. From the state of the art, this property of eriodictyol is known from EP 1 258 200 B1. Several flavonoids derived from eriodictyol are also of huge interest in the food and health industry, including hesperetin, hesperidin, neohesperidin, eriocitrin, neoeriocitrin and homoeriodictyol (cf. FIG. 13).

In contrast to the availability of eriodictyol from natural sources, the related substance naringenin (cf. FIG. 1 and FIG. 13) or its glycosides naringin and narirutin are available in sufficient amounts in various citrus species like for example grapefruit or bitter orange (*Poncirus trifoliata*). Therefore, naringenin and its related substances would basically to represent a suitable and cost-sensitive alternative starting material for obtaining eriodictyol.

Chemical oxidation, however, does not represent a suitable process for oxidizing a flavonoid ring without additionally oxidizing other positions in the ring system as side effect, whereas chemical oxidation will only yield mixtures of different oxidation products comprising eriodictyol, but not as the only product. Moreover, no single step chemical oxidation method for introducing an oxidation at a specific flavonoid ring position is currently known. Another problem is the further oxidation of the obtained products yielding chinon-like or higher molecular oxidation products of eriodictyol, respectively.

There is thus a persisting need for advancements in the field of enzymatic oxidation for use in biotechnology to yield eriodictyol similar to the natural process occurring during the canonical flavonoid biosynthetic pathway from naringenin to eriodictyol by hydroxylation, whereas this need always encompasses the wish to increase the yield and purity of the respective target compound.

Hydroxylations are a type of oxygen transfer reactions which functionalize organic molecules. The hydroxyl group is introduced by substitution of a hydrogen atom or—less commonly—of another functionality. Although these reactions are an essential part of the synthetic routes to a multiplicity of natural products, the selective introduction of a hydroxyl group into alkyl or, in particular, aryl moieties is one of the most challenging fields in synthesis. Hence, the number of methods for direct (aromatic) hydroxylation is still limited. In contrast to these chemosynthetic approaches, enzyme-mediated hydroxylation often proved to be more effective due to high regio- and/or stereoselectivity, and is increasingly favored while being more environmentally compatible (due to omission of reactive chemicals and the potential reduction in organic solvents). Indeed, biocatalytic oxidative transformations have been used for hydroxylation of structurally divergent compounds, including steroids, alkaloids, terpenoids or fatty acids. These enzymatic processes nearly exclusively rely on cytochrome P450-type enzymes, certainly because a multitude of these proteins has been produced recombinantly. In addition, many cytochrome enzymes are well characterized with respect to substrate scope, such as the enzyme from *Bacillus megaterium* and its variants.

A major problem associated with the establishment of suitable enzymatic procedures in this regard is the isolation or the stable expression of heterologous oxidases by means of molecular biology. Cytochrome P450 oxidases are ubiquitous enzymes occurring in all domains of life. Their function and most common reaction catalyzed by said enzymes is a monooxygenase reaction, e.g., the insertion of one atom of oxygen into the aliphatic position of an organic substrate while the other oxygen atom is reduced to water. Currently, it is notoriously difficult to express P450 oxidases in a heterologous way and to obtain a stable enzyme possessing its intrinsic enzymatic capabilities, still several suitable variants are already at hand, whereas the current research emphasis exclusively focused on the isolation and characterization of this class of enzymes and not the characterization thereof as regards there use in biotechnological methods defining, by means of metabolic engineering, a pathway and suitable host cells and substrates to utilize these P450 oxidases for complex in vivo and in vitro methods for yielding 3,4-dihydroxyphenol compounds in an industrial scale.

Alternatively, flavin-dependent monooxygenases are an interesting target for catalyzing hydroxylation reactions in biotechnology. These monooxygenases belong to a superfamily of enzymes that is involved in key metabolic processes in both prokaryotic and eukaryotic cells, such as the biosynthesis of polyketides, cholesterol or antibiotics. The classification of flavin adenine dinucleotide (FAD) dependent monooxygenases is based on structural features as well as on the type of electron donor and oxygen transfer. The prototypic enzyme 4-hydroxyphenylacetate 3-hydroxylase (4HPA3H or HpaB, EC 1.14.14.9) catalyzes the reaction of 4-hydroxyphenylacetate with oxygen to 3,4-dihydroxyphenylacetate. During the reaction water is formed by consumption of the cofactor $FADH_2$ which is produced from FAD by an additional flavin reductase component (HpaC, E.C. 1.5.1.36). Because its highly specific reaction is not restricted to the natural substrate 4-hydroxyphenylacetate, 4HPA3H is an attractive biocatalyst for challenging oxidation of monophenols to σ-diphenols (catechols), but so far no specific rational design of said enzyme has been performed to make it a suitable tool for versatile biotechnological applications in the industrial scale requiring high standards with respect to the stability, specificity and conversion rate of an enzyme. Notably, 4HPA3H-mediated hydroxylation proceeds without side reactions leading to undesired by-products. However, despite its efficiency and reaction specificity, applicability of 4HPA3H in biotechnology is still limited because a toolbox of enzymes with extended substrate scope, i.e. including natural products other than simple monophenols (such as flavonoids or alkaloids), is not yet available.

EP 14187583.1 describes the insertion of mutations into the genome of bacterial P450 oxidases to provide a recombinant microorganism which is able to produced eriodictyol from the starting material naringenin, however, the rate of catalysis obtained for this specific substrate is very low for the disclosed method and the subsequent isolation of the resulting product is laborious.

US 2014/0363858 A1 discloses a biotechnological method for oxidizing naringenin to eriodictyol using a native wild-type enzyme, i.e. the two component non-P450 hydroxylase HpaBC from *E. coli* that catalyzes the hydroxylation of 4-hydroxyacetate (4HPA) into 3,4-dihydroxyphenylacetate, the first step of the 4HPA degradation in *E. coli*. The large component HpaB of this two component enzyme represents a FADH2-utilizing monooxygenase, while the small component HpaC is an NAD(P)H-flavin oxidoreductase that acts as a coupling or cofactor recycling factor for supplying FADH2 to HpaB. As evident from FIG. 2C and as disclosed in paragraph [0093] of this US-application, the activity obtained towards naringenin was extremely low and the reaction rate for the conversion of naringenin to eriodictyol is extremely low and only proceeds incomplete (<10%), whereas the method as such is not suitable to generate eriodictyol in sufficient amounts and purities as required in the chemical, food and pharmaceutical industry for further use of the compound. No suggestions are made as to the possibility of genetically engineering the enzyme subunit HpaB responsible for the catalysis of the naringenin to eriodictyol reaction. Furthermore, US 2014/0363858 A1 discloses that the expensive cofactors NADH and FAD which are essential for the activity of the enzyme catalyzing the reaction from naringenin to eriodictyol have to be supplemented.

Consequently, there exists a long felt need for establishing biotechnological methods including both in vivo enzymatic methods using a whole-cell approach and in vitro enzymatic methods in a cell-free system, or a combination thereof, to catalyze the oxidation of different 4-hydroxyphenyl compounds and—in a coupled enzymatic reaction—also the further methylation of the resulting 3,4-dihydroxyphenyl compounds. Specifically, there is a need for genetically modified enzymes having an enhanced substrate spectrum and simultaneously high catalytic activity and region- and product specificity. Therefore, there is a need especially for suitable genetically engineered enzymes, which can be utilized in said reactions, which have to be designed by laborious rational design to yield enzymes, which can be stably and functionally produced, which provide high yields and strict region- and product specificity with respect to their substrates and which can be applied in vivo and in vitro systems, comprising a whole-cell approach and cell-free methods necessary for their broad applicability in an industrial scale. As regards enzymatic reaction, there is always the additional need to optimize the cost. Therefore, suitable cofactor recycling systems are demanded, fine-tuned concerning the specific reaction to be catalyzed and the enzyme used therefore, to achieve biotechnological methods which need less cofactor supplementation and are thus cost-saving.

SUMMARY OF THE INVENTION

The object of the present invention was thus the provision of genetically modified enzymes and nucleic acids encoding the same, belonging to the family of enzyme 4-hydroxyphenylacetate 3-hydroxylase (4HPA3H) derived from *E. coli* obtained by rational protein design, having an optimized substrate spectrum, and simultaneously good stability, functionality and activity and superior regio- and product specificity, or the provision of genetically modified enzymes and nucleic acids encoding the same, belonging to the P450 family of oxidases which can be heterologously expressed in high amounts and are suitable to convert 4-hydroxyphenyl compounds to 3,4-hydroxyphenyl compounds in whole-cell based as well as cell-free approaches. It was another object to integrate said enzymes as oxidation/hydroxylation catalyzing enzymes into biotechnological methods suitable for reliable production in an industrial scale and to define of a suitable cofactor recycling system.

This object has been achieved by providing a genetically modified *Escherichia coli* derived 4-hydroxyphenylacetate 3-hydroxylase or a catalytically active fragment thereof, comprising at least one mutation in its active site and by providing biotechnological methods functional both in a whole-cell approach and in a cell-free system for the conversion of at least one 4-hydroxyphenyl compound for producing at least one 3,4-dihydroxyphenol compound. Further, this method has been integrated in a complex biotechnological method comprising the subsequent methylation of the 3,4-dihydroxyphenol compound in a further step. Further suitable nucleic acid and amino acid sequences, vectors and recombinant host cells have also been provided. Finally, an optimized cofactor recycling system is suggested which can be used in combination with the methods according to the present invention.

In a first aspect, the present invention provides a method for catalyzing the biotechnological conversion of at least one 4-hydroxyphenyl compound for producing at least one 3,4-dihydroxyphenol compound, comprising the following steps of (i) providing at least one amino acid sequence comprising or consisting of a genetically modified *Escherichia coli* derived 4-hydroxyphenylacetate 3-hydroxylase or a catalytically active fragment thereof, comprising at least one mutation in its active site; (ii) providing at least one 4-hydroxyphenyl compound; (iii) reacting the at least one 4-hydroxyphenyl compound and the at least one amino acid sequence comprising or consisting of the 4-hydroxyphenylacetate 3-hydroxylase or the catalytically active fragment thereof under suitable reaction conditions for allowing the hydroxylation of the at least one 4-hydroxyphenyl compound by the at least one amino acid sequence comprising or consisting of the 4-hydroxyphenylacetate 3-hydroxylase or the catalytically active fragment thereof to yield at least one 3,4-dihydroxyphenol compound; and optionally isolating and/or purifying the resulting at least one 3,4-dihydroxyphenol compound.

In one embodiment, the method is performed as whole-cell approach. In another embodiment, the method is performed in a cell-free in vitro system.

In one embodiment, the methods according to the present invention are performed as a continuous flow process, preferably wherein the at least one amino acid sequence or catalytically active fragment thereof is provided immobilized on a suitable carrier. In another embodiment, the methods according to the present invention are performed as a batch process.

The method according to any aspect of the present invention optionally provides a suitable cofactor recycling system comprising or consisting of at least one amino acid sequence comprising a cofactor recycling enzyme, or a catalytically active fragment thereof.

According to one embodiment, the methods of the present invention use at least one genetically modified 4-hydroxyphenylacetate 3-hydroxylase or the catalytically active fragment thereof, or they use at least one recombinant nucleic acid molecule encoding the at least one genetically modified 4-hydroxyphenylacetate 3-hydroxylase or the catalytically active fragment thereof is, which is selected from the group consisting of SEQ ID NOs:2 to 79 and 99 to 175 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs provided that the genetic modification of the active site of the respective SEQ ID NO is still present in the homologous sequence and provided that the homologous sequence, optionally after expression, still provides 4-hydroxyphenylacetate 3-hydroxylase activity; and/or they use at least one cofactor recycling enzyme, or the catalytically active fragment thereof, or they use at least one recombinant nucleic acid molecule encoding the at least one cofactor recycling enzyme, or the catalytically active fragment thereof which is selected from the group consisting of SEQ ID NOs:80 to 86 and 176 to 182 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression, still provides cofactor recycling activity.

In one embodiment, the methods according to the present invention use a 4-hydroxyphenylacetate 3-hydroxylase or the catalytically active fragment thereof for hydroxylation of a substrate which, under suitable reaction conditions, provides suitable regio- and product specificity so that essentially no further conversion of the resulting at least one 3,4-dihydroxyphenol compound is effected.

In one embodiment of the methods of the present invention, the at least one 4-hydroxyphenyl compound is independently selected from the group consisting of naringenin, phloretin, p-coumaric acid, ferulic acid, resveratrol, p-hydroxybenzoic acid, 2-hydroxycarbazole, umbelliferone, rheosmin, or enantiomers, precursors or derivatives, including glycosides, including prunin, phloridzin, naringin, or narirutin, of the aforementioned molecules, but not restricted thereto, but also comprising structurally similar compounds, which can bind to and be transformed by a 4-hydroxyphenylacetate 3-hydroxylase or the catalytically active fragment thereof according to the present invention.

In a second aspect, the present invention is directed to a method for catalyzing the biotechnological conversion of at least one 4-hydroxyphenyl compound for producing at least one 3,4-dihydroxyphenol compound further methylated at the 3' and/or 4' position, comprising the following steps: (i) performing a method as defined in any one of claims 1 to 8 for providing at least one 3,4-dihydroxyphenol compound by employing a genetically modified hydroxylase or oxidase, or a catalytically active fragment thereof, wherein the hydroxylase or oxidase, or the catalytically active fragment thereof, catalyzes the hydroxylation of the at least one 4-hydroxyphenyl compound at the 3' position; (ii) providing at least one amino acid sequence comprising at least one O-methyltransferase or a catalytically active fragment thereof, or at least one recombinant nucleic acid molecule encoding the at least one O-methyltransferase or the catalytically active fragment thereof, and optionally providing a cofactor, preferably S-adenosylmethionine; and/or optionally providing a S-adenosylmethionine synthetase, or a catalytically active fragment thereof, or at least one recombinant nucleic acid molecule encoding the at least one S-adenosylmethionine synthetase or the catalytically active fragment thereof; (iii) reacting the at least one 3,4-dihydroxyphenol compound and the at least one amino acid sequence comprising the O-methyltransferase or the catalytically active fragment thereof under suitable reaction conditions for allowing the introduction of at least one methylation of the at least one 3,4-dihydroxyphenol compound by the at least one amino acid sequence comprising the O-methyltransferase or the catalytically active fragment thereof to yield at least one 3,4-dihydroxyphenol compound methylated at the 3' and/or 4' position; and (iv) optionally isolating and/or purifying the resulting at least one 3,4-dihydroxyphenol compound methylated at the 3' and/or 4' position.

In one embodiment of this further aspect, the at least one O-methyltransferase or the catalytically active fragment thereof, or the at least one recombinant nucleic acid molecule encoding the O-methyltransferase or the catalytically active fragment thereof is selected from the group consisting of SEQ ID NOs:87 to 89 and 193 to 197 and 183 to 185 and 198 to 202 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides O-methyltransferase activity, optionally after expression; and optionally, the at least one S-adenosylmethionine synthetase or the catalytically active fragment thereof, or the at least one recombinant nucleic acid molecule encoding the S-adenosylmethionine synthetase or the catalytically active fragment thereof is selected from the group consisting of SEQ ID NOs:90 to 94 and 186 to 190 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides S-adenosylmethionine synthetase activity, optionally after expression.

Further provided is a recombinant nucleic acid molecule as an aspect of the present invention comprising or consisting of a sequence selected from the group consisting of SEQ ID NOs:2 to 79, 95 and 96 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides 4-hydroxyphenylacetate 3-hydroxylase or oxidase activity after expression and provided that the homologous sequence still comprises the at least one genetic modification of the active site in comparison to the respective SEQ ID NO suitable for performing methods according to the present invention.

In addition, provided is a recombinant amino acid molecule as an aspect of the present invention comprising or consisting of a sequence selected from the group consisting of SEQ ID NOs:99 to 175, 191 and 192 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides 4-hydroxyphenylacetate 3-hydroxylase or oxidase activity and provided that the homologous sequence still comprises the at least one genetic modification of the active site in comparison to the respective SEQ ID NO suitable for performing methods according to the present invention.

The present invention additionally provides as an aspect a vector system comprising or consisting of at least one vector, wherein the at least one vector comprises (i) at least one recombinant nucleic acid molecule; and (ii) optionally: at least one recombinant nucleic acid molecule encoding at least one cofactor recycling enzyme, or a catalytically active fragment thereof, and/or (iv) optionally: at least one recombinant nucleic acid molecule encoding at least one O-methyltransferase or a catalytically active fragment thereof, and/or (v) optionally: at least one recombinant nucleic acid molecule encoding at least one S-adenosylmethionine synthetase or the catalytically active fragment thereof, wherein the at least one recombinant nucleic acid molecule according to (i), and optionally the at least one recombinant nucleic acid molecule according to (ii), and/or optionally the at least one recombinant nucleic acid molecule according to (iv), and/or optionally the at least one recombinant nucleic acid molecule according to (v) are provided on the same or on different vectors and correspond to recombinant nucleic acid molecules as presented above for the further aspects and embodiments of the present invention.

Furthermore, the present invention additionally provides as an aspect a recombinant host to cell comprising or consisting of at least one recombinant nucleic acid molecule as defined above for the specific aspects and embodiments according to the present invention, and/or comprising or consisting of at least one recombinant amino acid as defined above for the specific aspects and embodiments according to the present invention, and/or comprising or consisting of at least one vector system as defined above for the specific aspects and embodiments according to the present invention, preferably wherein the host cell is selected from the group consisting of procaryotic cells, including *Escherichia coli* spp., particularly *E. coli* BL21, *E. coli* BL21(DE3), *E. coli* MG1655 or *E. coli* W3110 and derivatives thereof, *Bacillus* spp., particularly *Bacillus licheniformis, Bacillus subitilis* or *Bacillus amyloliquefaciens*, and derivatives thereof, yeast cells, including *Saccharomyces* spp., particularly *S. cerevesiae*, and derivatives thereof, *Hansenula* or *Pichia* spp., particularly *P. pastoris* and *H. polymorpha*, and derivatives thereof, *Kluyveromyces* spp, particularly *K. lactis*, and derivatives thereof, fungi, including *Aspergillus* spp., particularly *A. oryzae, A. nidulans*, or *A. niger*, and derivatives thereof, or *Trichoderma* spp., particularly *T. reesei oder T. harzianum*, and derivatives thereof, insect cells, or mammalian cell-lines.

In one further aspect, the present disclosure provides a composition comprising naringenin and, preferably as an intermediate or as an educt, eriodictyol or homoeriodictyol in a ratio of 1:100 to 100:1 by wt. %, preferably in a ratio of 1:10 to 10:1 by wt. %, more preferably in a ratio of 1:5 to 5:1 by wt. %, or a composition comprising phloretin and 3-hydroxyphloretin in a ratio of 1:100 to 100:1 by wt. %, preferably in a ratio of 1:10 to 10:1 by wt. %, more preferably in a ratio of 1:5 to 5:1 by wt. %, obtainable by a method according to any one of the aspects and embodiments detailed above, wherein the at least one 4-hydroxyphenyl compound provided in step (ii) of claim is selected from naringenin or phloretin, including a precursor, enantiomer or derivative thereof.

As the various embodiments and aspects encompassed by the present disclosure all relate to possible of the present invention, they can be used alone or in combination with each other all forming individual embodiments according to the various aspects according to the present disclosure, where reasonable for the skilled person having knowledge of the present disclosure. Especially, all embodiments disclosed for the first aspect according to the present invention likewise apply for the second aspect of the present application, as both methods described by said aspects are built on each other.

Further aspects and embodiments of the present invention can be derived from the subsequent Detailed Description, the Drawings, the Sequence Listing as well as the attached set of claims.

BRIEF DESCRIPTION OF THE DRAWINGS

FIG. 1). Mixtures of caffeic acid and p-coumaric acid (1) were incubated with $FeCl_3$ and analyzed at 595 nm as described in the Experimental Section. (B) Time course of the oxidation of p-coumaric acid (1 cf. FIG. 1) by wild-type 4HPA3H. The enzymatic reaction was performed under optimized conditions, and produced caffeic acid (2 cf. FIG. 1) was detected as $Fe^{3+}$ complex. Data are the means±standard deviations obtained from three measurements.

FIG. 12 (B) shows an HPLC-chromatogram at the timepoint "30" min of the solid phase-based cascade reaction as detailed in Example 12. Besides the naringenin peak, an eriodictyol peak can now be detected. FIG. 12 (C) shows an HPLC-chromatogram at the timepoint "240" min of the solid phase-based cascade reaction as detailed in Example 12. As evident from this chromatogram, already after 4 h of reaction time, there is a pronounced eriodictyol peak besides the remaining naringenin peak. Notably, no side-products attributable to other substances other than eriodictyol or naringenin can be detected. All small peaks in this chromatogram are already present at the timepoint "0" (s. FIG. 12 (A)) and are thus attributable to molecules present in the initial solution.

DEFINITIONS

Figure 1:
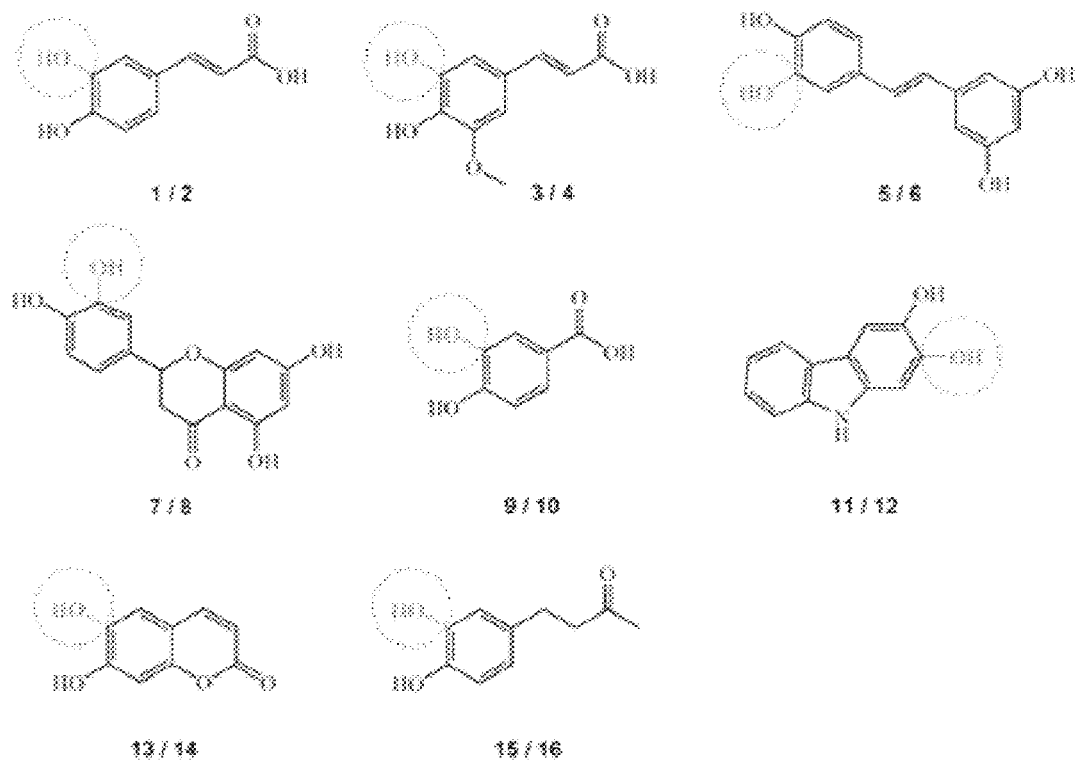
FIG. 1 shows substrates (odd numbers) used in hydroxylation reactions and corresponding catechol products (even numbers). The hydroxyl groups introduced into to the monophenols by 4HPA3H-mediated oxidation are depicted in grey and marked by a dotted circle. 1 p-coumaric acid, 2 caffeic acid, 3 ferulic acid, 4 5-hydroxyferulic acid, 5 resveratrol, 6 piceatannol, 7 naringenin, 8 eriodictyol, 9 p-hydroxybenzoic acid, 10 3,4-dihydroxybenzoic acid, 11 2-hydroxycarbazole, 12 2,3-dihydroxycarbazole, 13 umbelliferone, 14 esculetin, 15 rheosmin, 16 4-(3,4-dihydroxyphenyl)-butan-2-one.

The term "biotechnology" or "biotechnological" as used herein refers to methods and molecular tools relying on the use of a living substance, e.g. a host cell, or relying on a biocatalytic step comprising the use of an enzyme, or a catalytically active fragment or variant thereof mediating a chemical reaction, during at least one manufacturing step. This term is thus used as the counterpart of the term "chemical process" or "chemical synthesis". In the sense of the present disclosure biotechnological methods thus comprise whole-cell, i.e. in vivo, approaches wherein at least one amino acid is produced within a living cell and/or wherein a reaction of interest takes place in the presence of a recombinant host cell, either living or dead, comprising in vivo in the cell or in a suspension comprising the cells or in the supernatant of the culture medium comprising the cells, or in the lysate of cells without further purification. Furthermore, the term "biotechnological" comprises biocatalytical enzymatic in vivo and in vitro reactions which can take place without the presence of a recombinant host cell. Combinations of the aforementioned biotechnological methods are also comprised by the present disclosure.

The term "derivative" or "descendant" as used herein in the context of a recombinant host cell according to the present application relates to the descendants of such a recombinant host cell which result from natural reproductive propagation including sexual and asexual propagation. It is well known to the person having skill in the art that said propagation can lead to the introduction of mutations into the genome of an organism resulting from natural phenomena which results in a descendant or progeny, which is genomically different to the parental recombinant host cell, however, still belongs to the same genus/species and possesses the same characteristics as the parental recombinant host cell. Such derivatives or descendants resulting from natural phenomena during reproduction are thus comprised by the term recombinant host cell according to the present disclosure.

The term vector system as used herein defines a system comprising at least one vector, preferably a plasmid vector suitable for transformation, transfection or transduction of a recombinant host cell. A vector per se thus denotes a cargo for the delivery of a biomolecule into a host cell of interest. A vector system thus can comprise one vector encoding at least one target molecule, preferably a nucleic acid molecule, to be introduced into a host cell. A vector of the vector system can also comprise more than one target molecules to be introduced. Alternatively, the vector system can be built from several individual vectors carrying at least one target molecule to be introduced.

The terms protein, polypeptide and enzyme are used interchangeably herein. The term "amino acid" or "amino acid sequence" or "amino acid molecule" comprises any natural or chemically synthesized protein, peptide, polypeptide and enzyme or a modified protein, peptide, polypeptide and enzyme, wherein the term "modified" comprises any chemical or enzymatic modification of the protein, peptide, polypeptide and enzyme.

The terms "sequence(s)" and "molecule(s)" are used interchangeably herein when referring to nucleic acid or amino acid sequences/molecules.

"Active site" as used herein in connection with an enzyme or a catalytically active fragment thereof denotes the region of an enzyme where its substrate molecule(s) bind and undergo a chemical reaction.

The terms "genetically modified" or "recombinant" or "genetical engineering"/"genetically engineered" as used herein refer to a nucleic acid molecule or an amino acid molecule or a host cell implying a targeted and purposive manipulation and/or modification achieved by means of molecular biology or protein engineering, e.g. by introducing a heterologous sequence into another host cell. Further modifications include, but are not limited to, one or more point mutation(s), one or more point mutation(s), e.g. for targeted protein engineering or for codon optimization, deletion(s), and one or more insertion(s) of at least one nucleic acid or amino acid molecule, modification of an amino acid sequence, or a combination thereof.

The term "catalytically active fragment" as used herein referring to amino acid sequences denotes the core sequence derived from a given template amino acid sequence comprising all or part of the active site of the template sequence with the proviso that the resulting catalytically active fragment still possesses the activity characterizing the template sequence, herein the substrate binding and enzymatic activity of the template sequence, for which the active site of the native enzyme or a variant thereof is responsible. Said modifications are suitable to generate less bulky amino acid sequences still having the same activity as a template sequence making the catalytically active fragment a more versatile or more stable tool.

Whenever the present disclosure relates to the percentage of the homology or identity of nucleic acid or amino acid sequences these values define those as obtained by using the EMBOSS Water Pairwise Sequence Alignments (nucleotide) programme (http://www.ebi.ac.uk/Tools/psa/emboss_water/nucleotide.html) nucleic acids or the EMBOSS Water Pairwise Sequence Alignments (protein) programme (http://www.ebi.ac.uk/Tools/psa/emboss_water/) for amino acid sequences. Those tools provided by the European Molecular Biology Laboratory (EMBL) European Bioinformatics Institute (EBI) for local sequence alignments use a modified Smith-Waterman algorithm (see http://www.ebi.ac.uk/Tools/psa/ and Smith, T. F. & Waterman, M. S. "Identification of common molecular subsequences" *Journal of Molecular Biology*, 1981 147 (1):195-197). When conducting an alignment, the default parameters defined by the EMBL-EBI are used. Those parameters are (i) for amino acid sequences: Matrix=BLOSUM62, gap open penalty=10 and gap extend penalty=0.5 or (ii) for nucleic acid sequences: Matrix=DNAfull, gap open penalty=10 and gap extend penalty=0.5.

DETAILED DESCRIPTION

According to a first aspect of the present invention, there is provided a method for catalyzing the biotechnological conversion of at least one 4-hydroxyphenyl compound for producing at least one 3,4-dihydroxyphenol compound, comprising the following steps: (i) providing at least one amino acid sequence comprising or consisting of a genetically modified *Escherichia coli* derived 4-hydroxyphenylacetate 3-hydroxylase (4HPA3H) or a catalytically active fragment thereof, comprising at least one mutation in its active site; (ii) providing at least one 4-hydroxyphenyl compound; (iii) reacting the at least one 4-hydroxyphenyl compound and the at least one amino acid sequence comprising or to consisting of the 4-hydroxyphenylacetate 3-hydroxylase or the catalytically active fragment thereof under suitable reaction conditions for allowing the hydroxylation of the at least one 4-hydroxyphenyl compound by the at least one amino acid sequence comprising or consisting of the 4-hydroxyphenylacetate 3-hydroxylase or the catalytically active fragment thereof to yield at least one 3,4-dihydroxyphenol compound; and (iv) optionally isolating and/or purifying the resulting at least one 3,4-dihydroxyphenol compound.

The wild-type 4HPA3H underlying the analysis conducted for the present invention does not possess the ability to hydroxylate ferulic acid as does a homologous protein from *Pseudomonas aeruginosa*. To optimize the 4HPA3H for the purpose of the present invention and to gain insight into the architecture of the individual active sites, the three-dimensional structures of 44HPA3H and the corresponding *Pseudomonas aeruginosa* enzyme were modeled based on crystallographic data of the related enzyme from *Thermus thermophilus* (PDB accession 2YYJ) (cf. Example 1 below).

According to one embodiment according to the present invention, a genetically modified *Escherichia coli* derived 4-hydroxyphenylacetate 3-hydroxylase (4HPA3H) or a catalytically active fragment thereof thus comprises or consists of at least one mutation in the active site which comprises the residues I157, M293, Y301 and S462, wherein the nomenclature refers to the respective wild-type enzyme according to SEQ ID NO:98. In a preferred embodiment, the resulting amino acid sequence comprises at least one of a I157V, M239P, Y301I, Y301 L or S462A mutation or a combination thereof. Further preferred variants of SEQ ID NO:98 are detailed in the Examples. Preferred genetically modified *Escherichia coli* derived 4-hydroxyphenylacetate 3-hydroxylase (4HPA3H) or a catalytically active fragment thereof, comprises the mutations Y301I/S462A, I157V/Y301F, I157V/S462A, Y301 L/S462A or Y301I/S462A. The person having skill in the art knowing about the present disclosure having revealed the above essential active sites of *Escherichia coli* derived 4-hydroxyphenylacetate 3-hydroxylase (4HPA3H) and providing tests for assessing the substrate specificity can easily design further suitable variants using site-directed mutagenesis of the respective positions. All further variants of an *Escherichia coli* derived 4-hydroxyphenylacetate 3-hydroxylase (4HPA3H/HpaB) comprising one or more mutations at the I157, M239, Y301 or S462 are thus comprised by the present invention comprising a mutation against alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine or valine as represented in SEQ ID NOs:2 to 77 and 99 to 174 for the corresponding nucleic acid and amino acid sequences, respectively. Those variants are thus comprised by the disclosure of the present application providing the contribution of disclosing the relevant amino acid positions located in the active site of *Escherichia coli* derived 4HPA3H.

The term "*Escherichia coli* derived" thus implies that the respective sequence has its to natural origin in *Escherichia coli*.

In one embodiment according to the present invention there is provided a method, wherein the method is performed as whole-cell approach, and wherein step (i) according to the first aspect is performed as follows: (a1) providing at least one recombinant host cell comprising or consisting of the genetically modified 4-hydroxyphenylacetate 3-hydroxylase or the catalytically active fragment thereof, or comprising or consisting of at least one recombinant nucleic acid molecule encoding the genetically modified 4-hydroxyphenylacetate 3-hydroxylase or the catalytically active fragment thereof; (b1) optionally: providing at least one recombinant host cell comprising or consisting of at least one amino acid sequence comprising a cofactor recycling enzyme, or a catalytically active fragment thereof, wherein the at least one cofactor recycling enzyme is selected from the group consisting of a flavin reductase or a catalytically active fragment thereof, preferably a flavin reductase, or at least one recombinant nucleic acid molecule encoding a flavin reductase or a catalytically active fragment thereof; and/or a formate dehydrogenase or a catalytically active fragment thereof, or at least one recombinant nucleic acid molecule encoding the at least one formate dehydrogenase or the catalytically active fragment thereof, wherein the at least one recombinant host cell according to step (a1) and (b1) is the same or are different recombinant host cell(s), and (c1) cultivating said at least one recombinant host cell under suitable reaction conditions allowing the functional expression and/or catalytic activity of the at least one genetically modified 4-hydroxyphenylacetate 3-hydroxylase and optionally also allowing the functional expression and/or catalytic activity of the at least one amino acid sequence comprising a cofactor recycling enzyme or the catalytically active fragment thereof.

A whole-cell approach as also defined above is conducted in the presence of a host cell and thus includes biotechnological methods performed in vivo, fermentative, by using secretory tags to secrete a protein of interest into the culture supernatant, using suspensions of host cells and using lysates of host cells.

In one embodiment according to the methods provided by the present invention at least one cofactor recycling enzyme, or a catalytically active fragment thereof is used and provided either as a nucleic acid or as a amino acid molecule. It was one of the findings underlying the present application that the combination of the methods disclosed herein with a suitable cofactor recycling system specifically recycling and regeneration of the mandatory but costly cofactor NADH:NAD$^+$ formed during the reaction of the 4HPA3H according to the present application and to provide the necessary cofactor FADH2 (cf. FIG. 2). Preferred cofactor recycling enzymes for cascade biocatalysis to be combined with the methods according to the present invention, or the nucleic acid sequence to encoding the same can be one or more independently being selected from a formate dehydrogenase (FDH) from *Candida boidinii* (see SEQ ID NOs:81 and 177) or a flavin reductase (PrnF) from *Pseudomonas protegens* (see SEQ ID NOs:80 and 176) or a flavin reductase HpaC from *E. coli* (SEQ ID NOs:82 and 178), a glucose-dehydrogenase (GDH) from *Bacillus megaterium* (SEQ ID NOs: 83 and 179), a phosphonate dehydrogenase (PTDH), e.g., from *Pseudomonas stutzeri* (SEQ ID NOs:84 and 180), a glucose-6-phosphate dehydrogenase from *Leuconostoc mesenteroides* (G6PDH) (SEQ ID NOs:85 and 181), or a alcohol dehydrogenase, preferably a alcohol dehydrogenase 2 (ADH2) from *S. cerevisiae* (SEQ ID NOs:86 and 182) (cf. e.g. Riva, S. & Fessner, W.-D.; 23-42; Wiley-VCH, 2014; doi:10.1002/9783527682492). It is within the ability of the skilled person in the field of metabolic engineering to define further suitable enzymes which can be used for the purpose of providing a cofactor recycling system according to the present invention, and to combine them in a suitable way in the knowledge of the mechanism as detailed in FIG. 2.

In case of a whole-cell approach according to the methods of the present invention, endogenous enzymes of the recombinant host cell might be suitable to act as cofactor recycling system, e.g., the enzyme HpaC from *E. coli*, or the sequence encoding the same, according to SEQ ID NOs:82 or 178, either alone or in combination with a recombinant cofactor recycling system to be additionally introduced.

In a further embodiment according to the methods provided by the present invention, there is provided a method according to the first aspect, wherein the method is performed in a cell-free in vitro system, and wherein step (i) is performed as follows: (a2) providing at least one isolated amino acid sequence comprising or consisting of a genetically modified *Escherichia coli* derived 4-hydroxyphenylacetate 3-hydroxylase or a catalytically active fragment thereof, comprising at least one mutation in its active site; and (b2) optionally providing at least one amino acid sequence comprising or consisting of at least one cofactor recycling enzyme, or a catalytically active fragment thereof, wherein the at least one cofactor recycling enzyme is selected from the group consisting of a flavin reductase or a catalytically active fragment thereof, and/or a formate dehydrogenase or a catalytically active fragment thereof.

The term "isolated" implies that the amino acid sequence is provided independently of a recombinant host cell and thus comprises an amino acid sequence isolated from its expression host, optionally purified, or isolated from the supernatant in case of a secretory way of producing and discharging the sequence, or also including a chemically synthesized amino acid sequences, especially in the context of catalytically active fragments according to the present disclosure.

The person having skill in the art is well aware of the fact that the essential cofactors for the reaction catalyzed according to this aspect of the present invention (see, e.g. FIG. 2) have to be supplemented for in vitro approaches, even in higher amounts, in case no or a low amount of a cofactor recycling enzyme or a catalytically active fragment thereof is present in the reaction. Furthermore, the skilled person can easily define one or more other enzymes or catalytically active fragments thereof suitable as cofactor recycling enzymes in knowledge of the reaction mechanism as disclosed in FIG. 2, in case an enzymatic cofactor recycling is desired.

In one embodiment of the method according to the present invention, the biotechnological conversion of the at least one 4-hydroxyphenyl compound for producing at least one 3,4-dihydroxyphenol compound is performed as a continuous flow process, preferably wherein the at least one amino acid sequence or catalytically active fragment thereof having hydroxylase activity according to the present disclosure is provided immobilized on a suitable carrier. Such continuous flow processes are well known in the field of industrial biotechnology and can thus be readily adapted to be suitable to perform the methods according to the present disclosure.

"Immobilization" in the sense of the present disclosure means non-covalent, including electrostatic interactions, van der Waals forces, π-effects or hydrophobic interactions, as well as covalent immobilization. The term thus implies the fixation of an enzyme of interest, or of a catalytically active fragment thereof, onto a carrier. This can imply an interaction via a tag attached to the enzyme or catalytically active fragment thereof, hydrogen bonding, ionic bonding and the like, but also the permanent fixation via crosslinking to establish a covalent bond between the enzyme of interest and the carrier. Suitable carriers, including a variety of column materials optionally coupled to or including a reactive group, wherein the reactive group can interact with the enzyme to be immobilized permanently or reversibly, are known to the person having skill in the art.

In another embodiment according to the present disclosure, the method of biotechnological conversion of the at least one 4-hydroxyphenyl compound for producing at least one 3,4-dihydroxyphenol compound is performed as a batch process. This can imply in vivo and in vitro batch processes. Batch processes are well known in the field of industrial biotechnology and can thus be readily adapted to be suitable to perform the methods according to the present disclosure by the skilled person.

In a further embodiment according to the present disclosure, the methods are performed using specific enzymes, wherein the at least one genetically modified 4-hydroxyphenylacetate 3-hydroxylase or the catalytically active fragment thereof, or the at least one recombinant nucleic acid molecule encoding the at least one genetically modified 4-hydroxyphenylacetate 3-hydroxylase or the catalytically active fragment thereof is selected from the group consisting of SEQ ID NOs:2 to 79 and 99 to 175 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs provided that the genetic modification of the active site of the respective SEQ ID NO is still present in the homologous sequence and provided that the homologous sequence, optionally after expression, still provides 4-hydroxyphenylacetate 3-hydroxylase activity; and/or wherein the at least one cofactor recycling enzyme, or the catalytically active fragment thereof, or the at least one recombinant nucleic acid molecule encoding the at least one cofactor recycling enzyme, or the catalytically active fragment thereof is selected from the group consisting of SEQ ID NOs:80 to 86 and 176 to 182 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression, still provides cofactor recycling activity.

Figure 2:
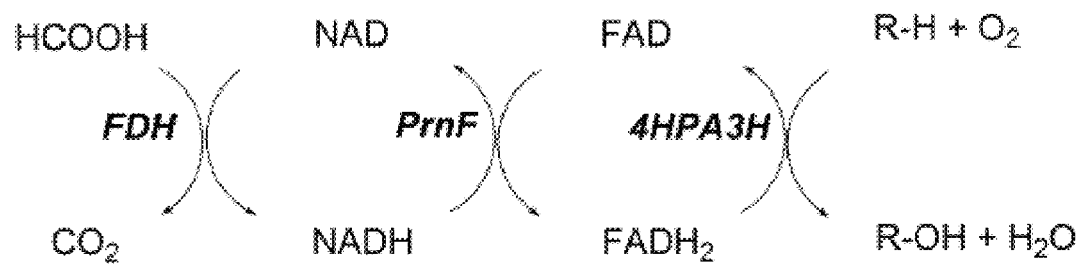
FIG. 2 shows a general scheme of the enzyme cascade for in vitro hydroxylation using 4HPA3H. For recycling of hydride-transferring cofactors, here exemplary a formate dehydrogenase (FDH) from *Candida boidinii* and the flavin reductase PrnF from *Pseudomonas protegens* were applied.

As detailed above, the use at least one cofactor recycling enzyme or a catalytically active fragment thereof for performing the methods of the present invention is a suitable and cost saving process, as the expensive cofactors necessary to perform the oxidation/hydroxylation of the 4-hydroxyphenol compound can be recycled instead of supplementing huge amounts of the respective cofactors identified to be mandatory (see FIG. 2). For in vivo applications, the use of cofactor recycling enzymes might not be necessary in case said cofactor recycling enzymes are already present in the recombinant host cell used. For in vitro applications, the use of one or more cofactor recycling enzyme or a catalytically active fragment thereof, and/or the use of the cofactors, alone or in combination, will be required to allow the activity of the main enzyme or catalytically active fragment thereof used for the bioconversion yielding a 3,4-dihydroxyphenol compound.

In a further embodiment according to the present invention, there is provided a method, wherein the hydroxylation in step (iii) according to the first aspect of the present invention is catalyzed by the at least one amino acid sequence comprising or consisting of the 4-hydroxyphenylacetate 3-hydroxylase or the catalytically active fragment thereof under suitable reaction conditions provides suitable regio- and product specificity so that essentially no further conversion of the resulting at least one 3,4-dihydroxyphenol compound is effected. It was found that mutation of SEQ ID NO:1 at least one position independently being selected from I157, M293, Y301 and S462 in the active site to a less voluminous and less sterically demanding group has a favorable effect with respect to the substrate tolerance of the enzyme still providing a high regio- and product specificity so that no further conversion of the starting material other than the desired hydroxylation at the 4' position is effected. The person having skill in the field of protein chemistry can easily derive that said characteristics apply to several possible mutants all carrying a less to voluminous amino acid at one of the specified positions of the active site. At the same time, it is known to the skilled person that even keeping a voluminous amino acid at a specific position in the active site, but simultaneously modifying another position comprised by the active site of an enzyme can easily be mutated to achieve further favorable enzyme characteristics like for example an enhanced catalytic rate. Relevant for introducing said mutations is the knowledge of the active site of an enzyme, as defined herein with reference to SEQ ID NOs:98 as nucleic acid and amino acid sequence, respectively, encoding *E. coli* 4HPA3H/HpaB.

In one embodiment concerning any of the disclosed methods according to the present invention, the at least one 4-hydroxyphenyl compound is independently selected from the group consisting of naringenin, phloretin, p-coumaric acid, ferulic acid, resveratrol, p-hydroxybenzoic acid, 2-hydroxycarbazole, umbelliferone, rheosmin, or enantiomers, precursors or derivatives, including glycosides, including pruning, phloridzin, naringin, or narirutin, of the aforementioned molecules, wherein the flavanones of the aforementioned molecules include (2S)- and/or (2R)-enantiomers thereof, but are not restricted thereto.

The term "precursor" as used in the present disclosure is meant to describe those compounds, which represent the antecedent compound as found during the natural biosynthetic pathway, or representing the antecedent step in a chemical synthesis, leading to a compound according to the present disclosure. For example, naringenin is a precursor of eriodictyol and eriodictyol is thus a precursor of the compound homoeriodictyol. A "derivative" in the context of a compound as used according to the present disclosure describes a variant of a core compound, which has been chemically or enzymatically modified, i.e. by methylation, hydroxylation, glycosylation, coupling to another compound and the like, whereas the core sequence of the non-derivatized compound is still present in the derivative.

All nucleic acid molecules according to the present disclosure can optionally be codon optimized. This implies that the codon usage of a given nucleic acid sequence can be modified to be compatible with the codon usage of a recombinant host cell of interest to allow better transcription rates and the expression of functional amino acid sequences in a recombinant host cell of interest. The person having skill in the art in the knowledge of the genetic code and the codon usage of a target recombinant host cell can easily adapt a nucleic acid molecule according to the present disclosure without effecting a change in the resulting amino acid sequence after translation. Therefore, codon-optimized sequences of the nucleic acid molecules according to the present invention are also comprised by the present disclosure. Furthermore, more than the specifically disclosed genetically modified enzymes or catalytically active fragments thereof of 4HPA3H are explicitly comprised by the present invention, provided that they comprise at least one or more mutation(s) at a position independently being selected from I157, M293, Y301 and to S462 in the active site with respect to SEQ ID NO:98 to another canonical amino acid sequence can be readily derived from the skilled person in the field of protein chemistry having knowledge of the contribution of the present invention which defines the importance of said concrete positions and the effect of a mutation thereof to another residue.

In a second aspect according to the present invention there is provided a method for catalyzing the biotechnological conversion of at least one 4-hydroxyphenyl compound for producing at least one 3,4-dihydroxyphenol compound further methylated at the 3' and/or 4' position, comprising the following steps: (i) performing a method as defined in any one of claims 1 to 8 for providing at least one 3,4-dihydroxyphenol compound by employing a genetically modified hydroxylase or oxidase, or a catalytically active fragment thereof, wherein the hydroxylase or oxidase, or the catalytically active fragment thereof, catalyzes the hydroxylation of the at least one 4-hydroxyphenyl compound at the 3' position; (ii) providing at least one amino acid sequence comprising at least one O-methyltransferase or a catalytically active fragment thereof, or at least one recombinant nucleic acid molecule encoding the at least one O-methyltransferase or the catalytically active fragment thereof, and optionally providing a cofactor, preferably S-adenosylmethionine; and/or optionally providing a S-adenosylmethionine synthetase, or a catalytically active fragment thereof, or at least one recombinant nucleic acid molecule encoding the at least one S-adenosylmethionine synthetase or the catalytically active fragment thereof; (iii) reacting the at least one 3,4-dihydroxyphenol compound and the at least one amino acid sequence comprising the O-methyltransferase or the catalytically active fragment thereof under suitable reaction conditions for allowing the introduction of at least one methylation of the at least one 3,4-dihydroxyphenol compound by the at least one amino acid sequence comprising the O-methyltransferase or the catalytically active fragment thereof to yield at least one 3,4-dihydroxyphenol compound methylated at the 3' and/or 4' position; and (iv) optionally isolating and/or purifying the resulting at least one 3,4-dihydroxyphenol compound methylated at the 3' and/or 4' position.

In one embodiment according to the second aspect of the present invention there is provided a method, wherein the at least one O-methyltransferase or the catalytically active fragment thereof, or the at least one recombinant nucleic acid molecule encoding the O-methyltransferase or the catalytically active fragment thereof is selected from the group consisting of SEQ ID NOs:87 to 89 and 193 to 197 and 183 to 185 and 198 to 202 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides O-methyltransferase activity, optionally after expression; and optionally, wherein the at least one S-adenosylmethionine synthetase or the catalytically active fragment thereof, or at least one recombinant nucleic acid molecule encoding the S-adenosylmethionine synthetase or the catalytically active fragment thereof is selected from the group consisting of SEQ ID NOs:90 to 94 and 186 to 190 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides S-adenosylmethionine synthetase activity, optionally after expression.

There is provided an embodiment, wherein the method according to the second aspect of the present invention comprises the use of a 3'-O-methyltransferase, or a catalytically active fragment thereof, or the use of a 4'-O-methyltransferase, or a catalytically active fragment thereof, or a combination of both, depending on the compound to be methylated and depending on the product which is intended to be achieved. Consequently, in one embodiment of the second aspect one methylation either at position 3' or 4' can be introduced, or, in another embodiment, both positions can be methylated simultaneously or consecutively.

As this second aspect implements and further utilizes the knowledge as disclosed above for the first aspect of the present invention, all embodiments according to the first aspect likewise represent embodiments for the second aspect according to the present invention.

According to one embodiment concerning the second aspect of the present invention, S-adenosylmethionine is provided as cofactor either for in vitro or for in vivo approaches. In the case of in vivo methods, the use of S-adenosylmethionine may be optional, in case the environment as provided by the recombinant host cell and the culture medium used for its propagation might already provide sufficient S-adenosylmethionine, however, the additional supply of this cofactor might still be beneficial in case high amounts of substrate to be methylated is present. In the case of in vitro methods, it is necessary to provide S-adenosylmethionine or a comparable source for providing a methyl donor.

For approaches comprising at least one in vivo step, S-adenosylmethionine can alternatively be provided by the activity of an S-adenosylmethionine synthetase or a catalytivcally active fragment thereof.

In another embodiment of the second aspect, there is thus provided an S-adenosylmethionine synthetase or a catalytically active fragment thereof, which can be utilized to provide the cofactor S-adenosylmethionine as cofactor for an O-methyltransferase or a catalytically active fragment thereof according to the present disclosure.

Preferred S-adenosylmethionine synthetases, or sequences encoding the same, to according to the present disclosure are independently selected from the group consisting of SEQ ID NOs:90 to 94 and 186 to 190 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides S-adenosylmethionine activity, optionally after expression.

Furthermore, in a further embodiment according to the second aspect of the present invention, the oxidase, or the catalytically active fragment thereof, catalyzing the hydroxylation of the at least one 4-hydroxyphenyl compound at the 3' position as to step (i), or the nucleic acid sequence encoding the oxidase, or the catalytically active fragment thereof can be independently be selected from the group consisting SEQ ID NOs:95 to 97, 191 and 192 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology thereto provided that the homologous sequence, optionally after expression, still provides cofactor recycling activity. A preferred oxidase, or the catalytically active fragment thereof, according to this embodiment is derived from *Bacillus megaterium* deposited as ATCC 14581 and includes at least one mutation at a position independently selected from the group consisting of A75, F88, L189 A331 and R472 with reference to the sequence as presented in SEQ ID NO:97.

As detailed above, the use at least one cofactor recycling enzyme or a catalytically active fragment thereof for performing the methods of the present invention is a suitable and cost saving process, as the expensive cofactors necessary to perform the oxidation/hydroxylation of the 4-hydroxyphenol compound can be recycled instead of supplementing huge amounts of the respective cofactors identified to be mandatory (see FIG. 2). According to one embodiment of the second aspect of the present invention the use of at least one cofactor recycling enzyme, or a catalytically active fragment thereof is thus implied by the method according to this second aspect.

For in vivo applications, the use of cofactor recycling enzymes might not be necessary in case said cofactor recycling enzymes are already present in the recombinant host cell used. For in vitro applications, the use of one or more cofactor recycling enzyme or a catalytically active fragment thereof, and/or the use of the cofactors, alone or in combination, will be required to allow the activity of the main enzyme or catalytically active fragment thereof used for the bioconversion yielding a 3,4-dihydroxyphenol compound to be further converted with the help of a O-methyltransferase to a methylated derivative to there.

According to a further aspect according to the present invention, which can be combined with the preceding aspects of the present invention, there is provided a recombinant nucleic acid molecule comprising or consisting of a sequence selected from the group consisting of SEQ ID NOs:2 to 79, 95 and 96 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% sequence homology to said SEQ ID NOs, provided that the respective homologous sequence still provides 4-hydroxyphenylacetate 3-hydroxylase or oxidase activity after expression and provided that the homologous sequence still comprises the at least one genetic modification of the active site in comparison to the respective SEQ ID NO.

The recombinant nucleic acid molecules according to this aspect are the result of a detailed study on the active site of the encoded enzyme 4HPA3H yielding information on those amino acid positions in the enzyme resulting after expression, which (i) define the active site and can thus also be made the basis for a core enzyme, i.e. a catalytically active fragment; (ii) which positions are necessary for substrate binding and conversion and (iii) which positions can be exchanged by means of site-directed mutagenesis to yield an enzyme or catalytically active fragment thereof with an enhanced substrate spectrum and at the same time providing a high catalytic rate, stability and region- and substrate specificity.

All recombinant nucleic acid molecules according to the present disclosure can optionally be codon optimized. This implies that the codon usage of a given nucleic acid sequence can be modified to be compatible with the codon usage of a recombinant host cell of interest to allow better transcription rates and the expression of functional amino acid sequences in a recombinant host cell of interest. The person having skill in the art in the knowledge of the genetic code and the codon usage of a target recombinant host cell can easily adapt a nucleic acid molecule according to the present disclosure without effecting a change in the resulting amino acid sequence after translation. Therefore, codon-optimized sequences of the nucleic acid molecules according to the present disclosure are also comprised by the present disclosure and are one reason for defining the degree of sequence homology as defined in the context of nucleic acid sequences.

In another aspect, there is provided a recombinant amino acid molecule comprising or consisting of a sequence selected from the group consisting of SEQ ID NOs:99 to 175, 191 and 192 or a homologous sequence having at least 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% to sequence homology to said SEQ ID NOs, provided that the respective homologous sequence still provides 4-hydroxyphenylacetate 3-hydroxylase or oxidase activity and provided that the homologous sequence still comprises the at least one genetic modification of the active site in comparison to the respective SEQ ID NO, wherein this aspect is based on those findings as detailed above for the aspect disclosing recombinant nucleic acid molecules according to the present invention.

In another aspect according to the present invention, there is provided a vector system comprising or consisting of at least one vector, wherein the at least one vector comprises (i) at least one recombinant nucleic acid molecule; and (ii) optionally: at least one recombinant nucleic acid molecule encoding at least one cofactor recycling enzyme, or a catalytically active fragment thereof, and/or (iv) optionally: at least one recombinant nucleic acid molecule encoding at least one O-methyltransferase or a catalytically active fragment thereof, and/or (v) optionally: at least one recombinant nucleic acid molecule encoding at least one S-adenosylmethionine synthetase or the catalytically active fragment thereof, wherein the at least one recombinant nucleic acid molecule according to (i), and optionally the at least one recombinant nucleic acid molecule according to (ii), and/or optionally the at least one recombinant nucleic acid molecule according to (iv), and/or optionally the at least one recombinant nucleic acid molecule according to (v) are provided on the same or on different vectors and correspond to recombinant nucleic acid molecules as presented above for the further aspects and embodiments of the present invention.

The choice of a suitable single vector building the scaffold for a vector system of the present invention is well within the ability of the person skilled in the art depending on the chosen recombinant host cell of interest. Said vectors are commercially available and can easily be adapted for utilizing them as cargos for nucleic acid sequences according to the present disclosure.

All amino acid sequences according to the various embodiments according to the present application can be produced using recombinant DNA techniques, including the use of a suitable expression vector present in a recombinant host cell. Such methods are routine and known in the art and the skilled person is able to define a vector and its necessary and optional components to obtain an expression vector or an integrating vector capable of (i) replicating in a host cell and to build the template for transcribing and subsequently expressing a nucleic acid molecule according to the present disclosure ligated into said expression vector, or (ii) capable of integrating the ligated nucleic acid molecule encoding the enzyme or catalytically fragment thereof according to the present invention into a host cell's genome. Furthermore, especially in the context of catalytically active fragments according to the present disclosure, said fragments can be obtained by chemical synthesis, and can be optionally ligated together to result in a functional catalytically active fragment according to the present disclosure.

The polypeptides, especially catalytically active fragments, may also be synthesized in vitro, e.g., by solid phase peptide synthetic methods. The solid phase peptide synthetic methods are routine and known in the art. A polypeptide produced using recombinant techniques or by solid phase peptide synthetic methods can be further purified by routine methods, such as fractionation on immunoaffinity or ion-exchange columns, ethanol precipitation, reverse phase HPLC, chromatography on silica or on an anion-exchange resin such as DEAE, chromatofocusing, SDS-PAGE, ammonium sulfate precipitation, gel filtration using, for example, Sephadex G-75, or ligand affinity.

According to one embodiment of the present invention, all nucleic acid or amino acid sequences according to the present invention or disclosure can additionally comprise a tag sequence. A tag sequence is a nucleic acid or amino acid sequence portion which can be located in front, in the middle or at the end of a sequence of interest, encoding or representing a sequence allowing the better analysis of a sequence of interest, wherein the analysis includes, but is not restricted to the purification, visualisation or further processing of a sequence of interest. Suitable tags can be selected from the group consisting of a polyhistidin(His)-Tag, a glutathione-S-transferase (GST)-tag, a thiore-doxin-tag, a FLAG-tag, a Tag having fluoresecent properties, selected from (E)GFP ((enhanced) green fluorescent protein) tag, a DsRed-tag, a mCherry-tag and the like or, a strepta-vidin or strep-tag, a maltose-binding protein (MBP) tag, a transit peptide allowing the targeting to a subcellular compartment, including mitochondria or the nucleus, a snap-tag and/or a secretion tag allowing the secretion of an amino acid sequence attached thereto, a non-naturally amino acid not normally occurring in nature, or a combination of the aforementioned tags.

As defined above, a catalytically active fragment according to the present disclosure defines a minimal sequence comprising all or part of the active site of an enzyme still fulfilling the enzymatic function of the enzyme it is derived of. By conjugating other effectors or catalytically active fragments, the function of a catalytically active fragment according to the present disclosure can be further fine-tuned and adapted to the methods, wherein said molecules are to be utilized. Said further modifications can be introduced on the nucleic acid level or on the amino acid level. Such modified sequences which are readily available to the skilled person, are also comprised by the present disclosure.

The vector system comprising or consisting of at least one vector is suitable for both, the in vivo as well as the in vitro approaches according to the first and the second aspect of the present invention, as it can be utilized to provide the desired enzymes or catalytically active fragments thereof. Furthermore, the vector system comprising or consisting of at least one vector is suitable for the provision of the encoded at least one enzyme or catalytically active fragment thereof independent of the above disclosed first or second aspect, and can also be utilized to provide the encoded at least one enzyme or catalytically active fragment for other assays or methods or as the basis for further genetic modification of the sequences comprised by the at least one vector in the system.

In another aspect of the present invention, there is provided a recombinant host cell comprising or consisting of at least one recombinant nucleic acid molecule as defined in the above aspect concerning recombinant nucleic acid molecules of the present invention, and/or comprising or consisting of at least one recombinant amino acid as defined in the above aspect concerning recombinant amino acid molecules of the present invention, and/or comprising or consisting of at least one vector system as defined in the above aspect concerning a vector system of the present invention comprising or consisting of at least one vector, preferably wherein the host cell is selected from the group consisting of procaryotic cells, including *Escherichia coli* spp., particularly *E. coli* BL21, *E. coli* BL21(DE3), *E. coli* MG1655 or *E. coli* W3110 and derivatives thereof, *Bacillus* spp., particularly *Bacillus licheniformis, Bacillus subitilis* or *Bacillus amyloliquefaciens*, and derivatives thereof, yeast cells, including *Saccharomyces* spp., particularly *S. cerevesiae*, and derivatives thereof, *Hansenula* or *Pichia* spp., particularly *P. pastoris* and *H. polymorpha*, and derivatives thereof, *Kluyveromyces* spp, particularly *K. lactis*, and derivatives thereof, fungi, including *Aspergillus* spp., particularly *A. oryzae, A. nidulans,* or *A. niger*, and derivatives thereof, or *Trichoderma* spp., particularly *T. reesei oder T. harzianum*, and derivatives thereof, insect cells, or mammalian cell-lines.

Methods and means for cultivating a recombinant host cell according to the present disclosure which allow the viability of the respective host cell and which allow the introduction, maintenance and transcription, translation and possibly secretion of the vectors, nucleic acid and amino acid molecules disclosed herein are well known to the person having skill in the art.

A recombinant host cell "comprising" at least one recombinant nucleic acid molecule according to the present invention as insert thus implies a host cell carrying said insert on an extrachromosomally replicating vector or having said insert stably integrated into its genome. Likewise, this term a recombinant host cell "comprising" denotes a host cell which is provided with at least one nucleic acid sequence, optionally modified, and/or at least one amino acid sequence, optionally modified, or fusion molecules thereof, wherein the sequences have been produced fermentative (in another host cell or organism) and/or chemically, in vitro or in vivo, but outside, i.e. ex vivo, with respect to said recombinant host cell.

Suitable host cells according to the present invention are, for example, selected from the group consisting of procaryotic cells, including *Escherichia coli* spp., particularly *E. coli* BL21, *E. coli* BL21(DE3), *E. coli* MG1655 or *E. coli* W3110 and derivatives thereof, *Bacillus* spp., particularly *Bacillus licheniformis, Bacillus subitilis* or *Bacillus amyloliquefaciens*, and derivatives thereof, yeast cells, including *Saccharomyces* spp., particularly *S. cerevesiae*, and derivatives thereof, *Hansenula* or *Pichia* spp., particularly *P. pastoris* and *H. polymorpha*, and derivatives thereof, *Kluyveromyces* spp, particularly *K. lactis*, and derivatives thereof, fungi, including *Aspergillus* spp., particularly *A. oryzae, A. nidulans,* or *A. niger*, and derivatives thereof, or *Trichoderma* spp., particularly *T. reesei oder T. harzianum*, and derivatives thereof, insect cells, or mammalian cell-lines suitable and optimized for recombinant protein expression.

Suitable reaction conditions as referred to herein, including inter alia buffers, including buffer composition and pH, additives, temperature- and pH-conditions, reaction times and the like can be readily determined by the skilled person in knowledge of the disclosure provided herein, especially the knowledge about the nature of the enzymes and substrates and their catalytical activity, including possible necessary cofactors.

In a further aspect of the present invention there is provided a composition comprising naringenin and, preferably as an intermediate or as an educt, eriodictyol or homoeriodictyol in a ratio of 1:100 to 100:1 by wt. %, preferably in a ratio of 1:10 to 10:1 by wt. %, more preferably in a ratio of 1:5 to 5:1 by wt. %, or a composition comprising phloretin and 3-hydroxyphloretin in a ratio of 1:100 to 100:1 by wt. %, preferably in a ratio of 1:10 to 10:1 by wt. %, more preferably in a ratio of 1:5 to 5:1 by wt. %, obtainable by a method according to any one of the aspects and embodiments detailed above in relation to the methods according to the present application, wherein the at least one 4-hydroxyphenyl compound provided in step (ii) of claim is selected from naringenin or phloretin, including a precursor, enantiomer or derivative thereof.

In one embodiment of this aspect, the composition is obtained by using naringenin as starting material either by an in vivo or an in vitro approach as disclosed for the methods according to the present invention. Due to the high region- and substrate specificity, the biotechnological methods disclosed herein provide a high substrate turnover and at the same time do not lead to undesired side products (cf. FIG. 12). In one embodiment, the educt is eriodictyol, in case a one step biocatalytic method according to the first aspect of the present invention is conducted. In another embodiment, the educt is homoeriodictyol, in case the two step biocatalytic method according to the second aspect of the present invention is conducted. In another embodiment, the starting material by either an in vivo or an in vitro approach as disclosed for the methods according to the present invention is phloretin and the educt one step biocatalytic method according to the first aspect of the to present invention, either conducted as an in vivo or an in vitro approach, is 3-hydroxyphloretin.

The present invention is further described with reference to the following non-limiting examples.

EXAMPLES

The present invention is further illustrated by the following non limiting examples.

Example 1: Protein Modeling, Identification of Relevant Positions in the Active Site of 4HPA3H and Protein Expression The wild-type 4HPA3H underlying the analysis conducted for the present invention does not possess the ability to hydroxylate ferulic acid as does a homologous protein from *Pseudomonas aeruginosa*. To optimize the 4HPA3H for the purpose of the present invention and to gain insight into the architecture of the individual active sites, the three-dimensional structures of 4HPA3H and the corresponding *Pseudomonas aeruginosa* enzyme were modeled based on crystallographic data of the related enzyme from *Thermus thermophilus* (PDB accession 2YYJ). Both models were aligned to the template which also contains the substrate 4-hydroxyphenylacetate and FAD to inspect the active site of the enzyme 4HPA3H which are proximate to the aromatic ring of 4-hydroxyphenylacetate bound in the active site for the targeted mutagenesis fur the purpose of the present application. Notably, only three positions which differ in the enzymes from *E. coli* (M293, Y301, S462) and *Pseudomonas aeruginosa* (P293, F301, A462) were identified. Remarkably, all these positions are occupied by less voluminous residues in the latter enzyme, resulting in a more spacious active site. Thus, those residues were substituted the enzyme from *E. coli* to shift the substrate scope in favor of more bulky substrates, yielding the variants M293P, Y301F and S462A. For similar reasons, isoleucine 157 which seems to directly interact with the phenolic moiety of 4-hydroxyphenylacetate was exchanged against valine. Several other mutations for the positions 157, 293, 301 and 462 were conducted demonstrating that said positions are indeed crucial for the enzymatic activity, especially concerning substrate specificity and regio selectivity of the resulting mutated variants.

Figure 4A:
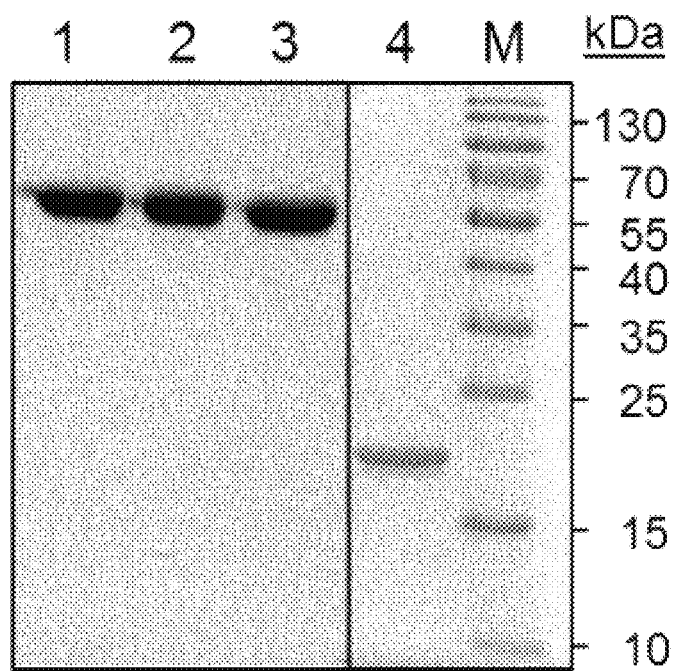
FIG. 4 shows (A) an SDS-PAGE of purified enzymes used in in vitro hydroxylation. Equal amounts of protein (5 μg) were used for separation in polyacrylamide gels with (10% (w/v) crosslinking. Lane 1: wild-type 4HPA3H, lane 2: 4HPA3H-Y301I, lane 3: 4HPA3H-Y301F/S462A, lane 4: PrnF, M: molecular marker and (B) an SDS-PAGE of purified enzymes used for in vitro hydroxylation studies, showing on a 14% gel several enzymes including enzymes used as cofactor recycling enzymes.
Figure 4B:
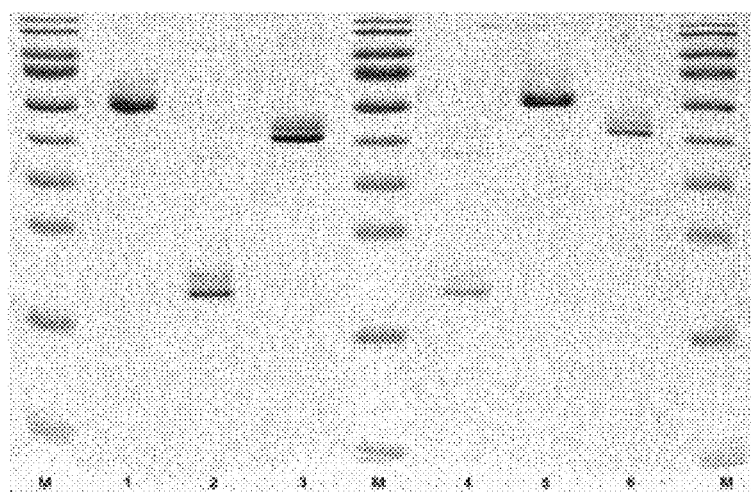
Figure 5:
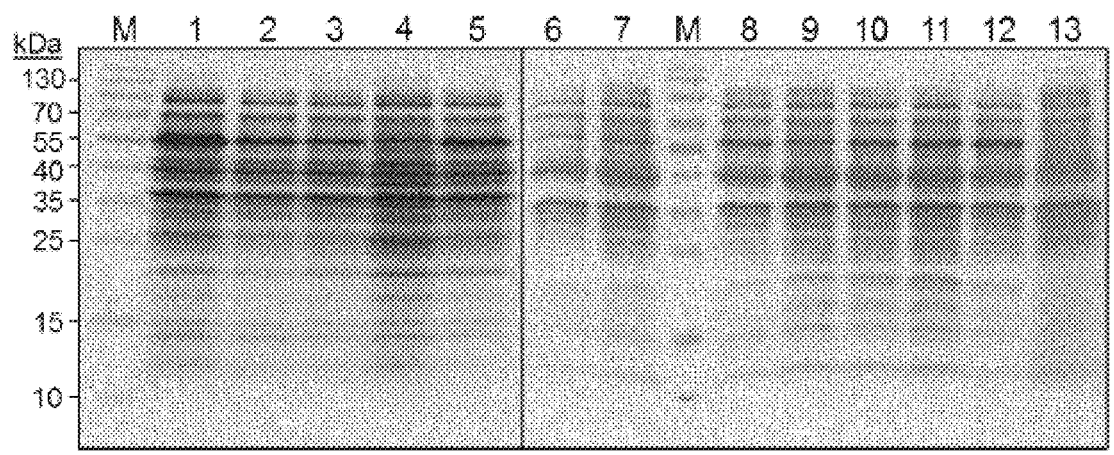
FIG. 5 shows an SDS-PAGE of cells expressing 4HPA3H (lane 1), the variants Y301F (lane 2), S462A (lane 3), M293P (lane 4), I157V (lane 5), Y301 L (lane 6), Y301I (lane 7), Y301F/S462A (lane 8), Y301 L/S462A (lane 9), Y301I/S462A (lane 10), Y301F/I157V (lane 11) and I157V/S462A (lane 12), or harboring the empty vector pET28a(+) (lane 13). Lysates from equal amounts of cells were applied to polyacrylamide gels with 10% (w/v) crosslinking. M: molecular markers.

Examples for the expression and optionally purification of selected 4HPA3H variants according to the present invention are illustrated in FIGS. 4 and 5, respectively, produced in *E. coli* BL21(DE3). After codon optimization and by using different commercially available expression vectors, further expression studies were conducted using yeast and fungus as recombinant expression hosts which also resulted in a good yield and functionally expressed enzymes (data not shown). Furthermore, a library of further single, double, triple and quadrupol mutants of 4HPA3H was generated starting by generating further to single point mutation variants by mutating each of the positions 157, 293, 301 and 462 against any possible canonical amino acid. Besides the mutants described and tested in detail, mutants having at least one mutation at position 301, namely Y301S, especially in combination with a mutation at position 462, especially S462A and S462G provided promising results. Furthermore, mutation of M293 to cysteine, serine, valine, isoleucine and alanine and additionally to lysine provided mutants with favorably enhanced characteristics, either concerning their stability, substrate tolerance in the active site or concerning the catalytic rate for the starting materials as depicted in FIG. 1. Further favorably mutations enhancing the substrate specificity were introduced at position I157, wherein mutations against serine, cysteine, threonine, asparagine and glutamine were introduced which proved to have superior characteristics in comparison to the wild-type enzyme. Strikingly, a targeted combination of mutations in the above identified amino acids belonging to the active site of 4HPA3H thus provides a toolbox for the targeted and site-directed mutagenesis of the enzyme which also allows the generation of an enzyme with a further optimized peculiar excellent performance towards one substrate of interest.

Example 2: In Vivo Hydroxylation Reactions and Impact of 4HPA3H

In order to probe the substrate requirements of 4HPa3H from *E. coli*, whole-cell biocatalysts were used which proved to be well suited for conducting hydroxylation reactions. The expression strain BL21(DE3) was used producing high levels of the recombinant monooxygenase (up to 246 mg l$^{-1}$ of culture) under auto-inducing conditions, but the cells were not co-transformed with a plasmid harboring the gene for a flavin reductase component as the endogenous activity proved to be sufficient to enable in vivo transformation of substrates. Suspensions of the cells were tested for hydroxylation of a panel of eight phenolic compounds (FIG.

Figure 3A:
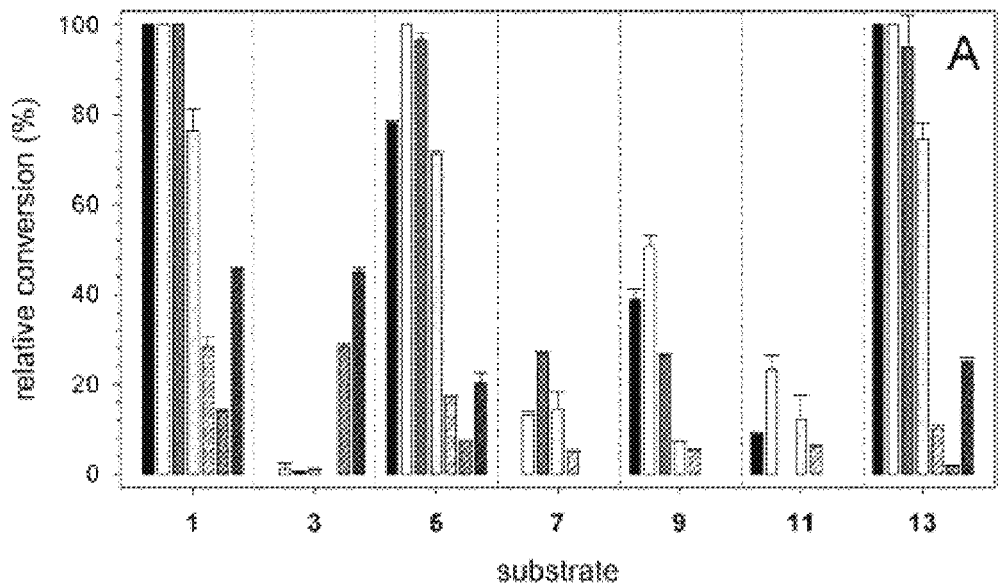
FIG. 3 shows the hydroxylation with life whole-cell biocatalysts. Substrates (200 µM) as shown in FIG. 1 were added to suspensions of bacterial cells expressing 4HPA3H or its single (A) and double variants (B). After incubation for 16 hours, catechols and residual substrates were extracted and analyzed by HPLC

1) which belong to different classes of natural products: we included (I) phenolic acids and ketones such as p-coumaric acid (1), ferulic acid (3), rheosmin (15) and p-hydroxybenzoic acid (9), (II) polycyclic compounds such as the hydroxycoumarin umbelliferone (13), the stilbene resveratrol (5) and the flavonoid naringenin (7). Additionally, 2-hydroxycarbazole (11) was included, a readily available alkaloid-like substrate resembling carbazoles from plant (clauralia alkaloids) or bacterial origin (carazostatin, carbazomadurins). Similar to its known substrate 1, the cells also converted the compounds 13 and 15 with high efficiency (100%) (FIG. 3A). Remarkably, the biocatalysts were also capable of hydroxylation of 5, 9 and 11, although lower yields of catechol products were obtained (78, 39 and 9%). A potential involvement of other endogenous monooxygenases in these conversions was ruled out by control reactions (i.e. application of cells harboring the empty vector) which showed no conversion. In contrast to the substrates mentioned above, ferulic acid (3) and naringenin (7) were not accepted, most probably because of their bulky methoxy (3) or chromanone substituent (7) by the wild-type enzyme. 4HPA3H was also tested for conversion of 4-methoxycinnamic acid and 4-aminocinnamic acid. These two analogues of p-coumaric acid (1) were no substrates for the enzyme (data not shown). Hence, in accordance with a previous study (which showed that 4HPA3H enzymes are unable to hydroxylate cinnamic acid), the presence of a phenolic hydroxyl group in the substrate seems to be mandatory for enzymatic turnover.

Remarkably, the enzymes 4HPA3H-Y301F and -S462A were comparably active towards substrates which were also well-accepted by the wild-type enzyme (1, 13, 15 in FIG. 1), whereas the variants M293P and, in particular, I157V showed reduced activity (see FIG. 3). This reduced activity was only observed against the natural substrate. Still said positions M293 and I157 proved to be valuable targets for the generation of mutants having more than one mutation in the active site to modulate substrate specificity and catalytic rate.

Figure 3B:
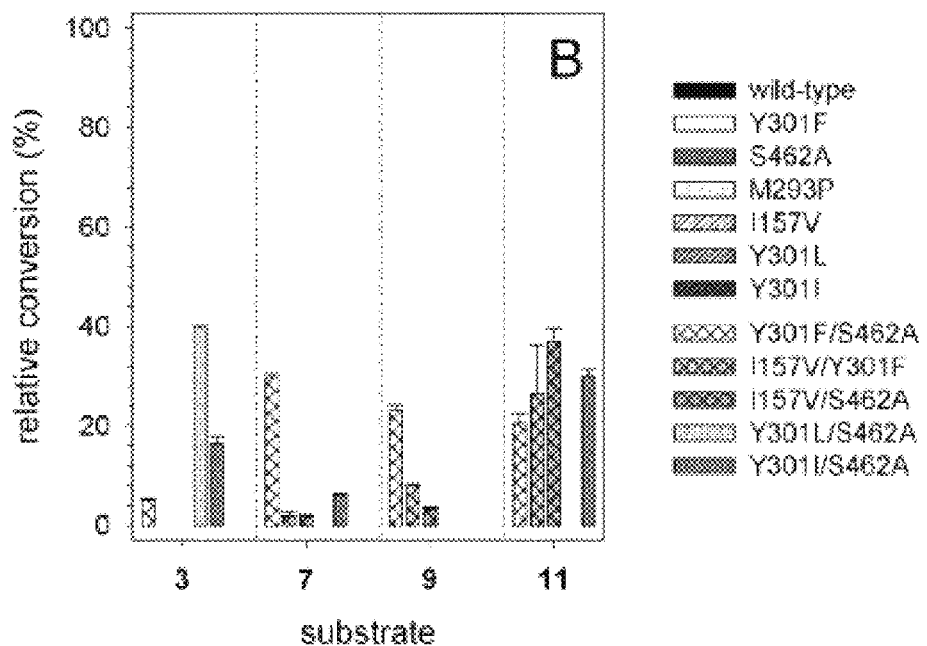

The variants are characterized by an altered substrate specificity: the enzyme Y301F proved to be superior in conversion of the substrates 5, 9 and 11 (cf. FIG. 1). Strikingly, most variants were also capable of oxidation of naringenin (7) and, to a minor extend, of ferulic acid (3). This effect was even more pronounced in some double variants which produced up to 26 (I157V/Y301F) and 30% (Y301F/S462A) of catechol from the bulky substrates 2-hydroxycarbazole (11) and naringenin (7) (FIG. 3B). As especially the substitution Y301F seems to be have greatest impact on acceptance of challenging compounds, we decided to introduce a leucine or isoleucine into this position. Both amino acids are similar to phenylalanine with respect to hydrophobicity, but are smaller in size. Strikingly, the preferred substrate of the resulting mutant enzymes was ferulic acid (3) (which was converted up to 45% in particular by 4HPA3H-Y301I), excelling well-known substrates such as p-coumaric acid (1) (FIG. 3A). Obviously, subtle changes in size and hydrophobicity of the active site—e.g. the formal replacement of a hydroxyl group by a hydrogen atom in the variants Y301F and S462A only—are sufficient to change the substrate scope of 4HPA3H enzymes. Several variants obtained by error-prone polymerase chain reaction were capable of conversion of the phenols lacking the carboxyl group of the natural substrate. This altered substrate preference was attributed to minor changes in second-shell positions which influence the positioning of active site residues.

Further experiments were conducted with a variant comprising three or four mutations in the active site residues 157, 293, 301, and 462, which all yielded enzymes with improved binding and catalysis characteristics suggesting the importance of those residues for targeted rational design of 4HPA3H.

The variants and the wild-type enzyme were applied for in vivo hydroxylation reactions after appropriate expression was confirmed by SDS-PAGE (see FIGS. 4 and 5).

Example 3: Product Specificity of 4HPA3H and Variants

To gain structural information on the hydroxylation products, we performed whole-cell biotransformations in a large scale (500 mL of cell suspension). Each substrate was to converted by the enzyme variant that showed highest conversion in the analytic in vivo reactions (see above). Similar to those transformations, the catechol products were extracted from the reaction mixture after 16 hours of incubation. The compounds which were purified by preparative reserved-phase HPLC, were identified as the catechols shown in FIG. 1 by $^1$H-NMR, MS and MS$^2$ measurements. Noteworthy, 4HPA3H and its variants demonstrated strict regio- and product specificity. In contrast to the enzyme from *Pseudomonas aeruginosa*, which performs sequential hydroxylation, no further conversion of the catechols into pyrogallol-like polyphenols was observed for both the wild-type enzyme and its variants.

Example 4: Activity of 4HPA3H and Variants In Vitro and Characterization of Suitable Cofactor Recycling Enzymes In order to characterize 4HPA3H and its variants with respect to specific activity, the development of a convenient in vitro assay was necessary. As the enzymes rely on a reductase component which provides the cofactor FADH$_2$ (see FIG. 2), the inventors focused on screening of a suitable reductase enzyme in the first step. The flavin reductase HpaC from *E. coli*—the endogenous partner of 4HPA3H— was not accessible due to formation of mainly insoluble protein under a variety of expression conditions (data not shown). In the search for homologous proteins, PrnF from *Pseudomonas protegens* Pf-5 (NCBI accession AAY91318.1) which is a part of the pseudomonad two-component arylamine oxygenase system showed to have high sequence identity (99%) to the strain *Pseudomonas protegens* CHA0. Recombinant PrnF proved to be well expressed in *E. coli* (in a yield of 175 mg l$^{-1}$ of culture). The purified protein was highly active in reduction of FAD with NADH (16,660±1,600 nmol min$^{-1}$ mg$^{-1}$).

Figure 6A:
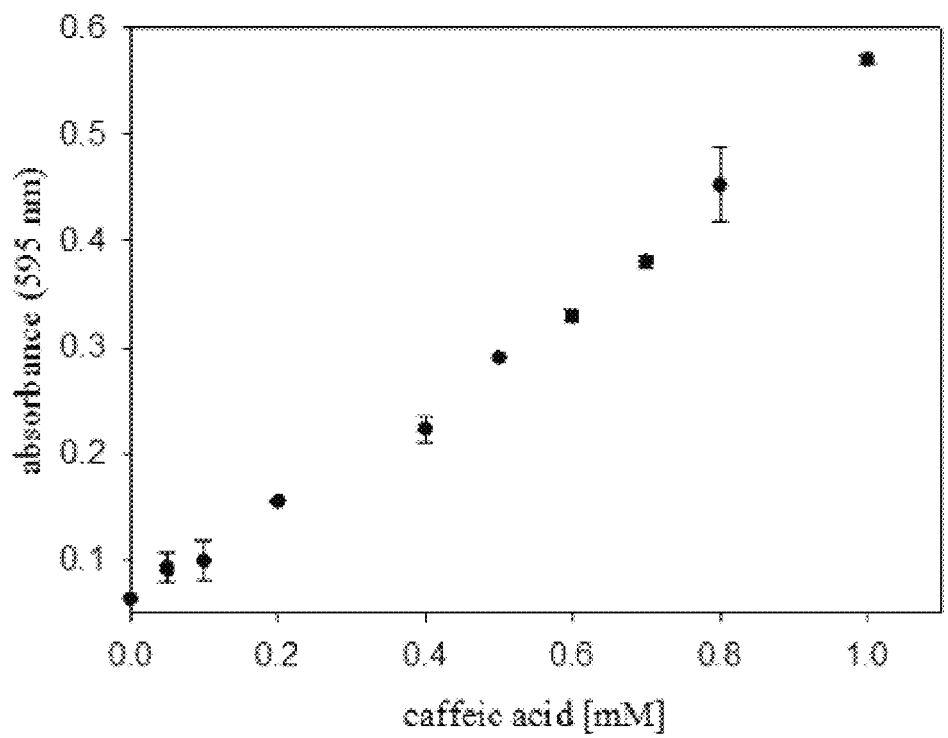
FIG. 6 shows a catechol complex formation assay for determination of 4HPA3H activity. (A) Standard curve for the determination of caffeic acid (2 cf.
Figure 6B:
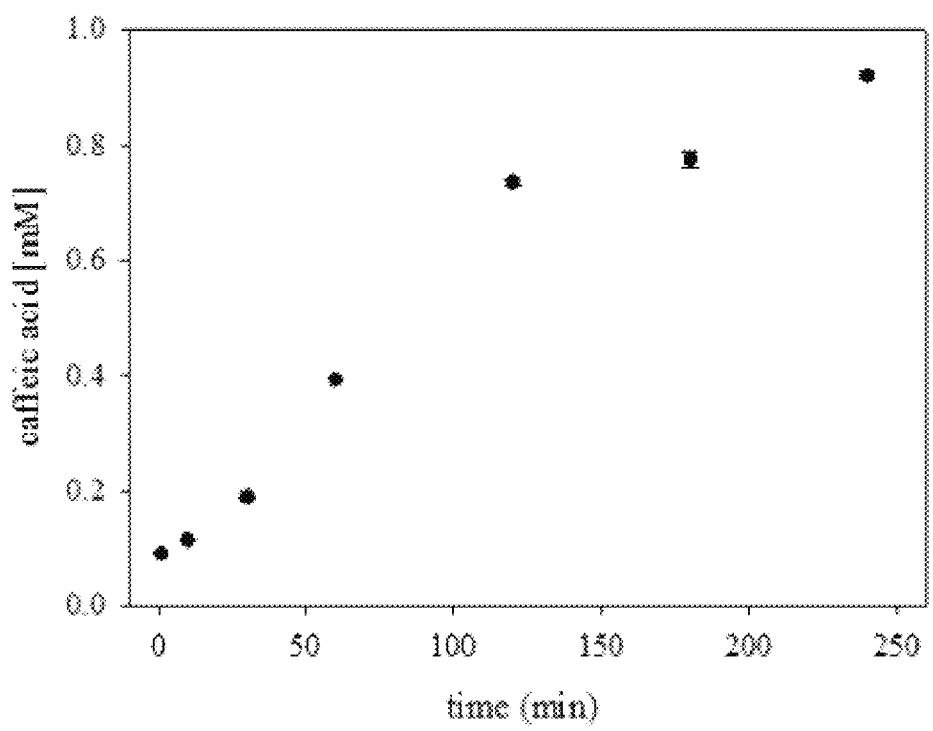

For assaying 4HPA3H in microplate scale, 4HPA3H was incubated with PrnF, the substrate p-coumaric acid (1 cf. FIG. 1) and the formate dehydrogenase (FDH) from *Candida boidinii*. Similar as reported in our previous publication, this enzyme was introduced for regeneration of the costly cofactor NADH: NAD$^+$ formed during the reaction is recycled with sodium formate, yielding a sequential three-enzyme cascade for hydride transfer (FIG. 2). The conversion of p-coumaric acid (1 cf. FIG. 1) was measured spectrophotometrically by a previously established catechol complexation method (M. Dippe, B. Weigel, R. Heinke, T. Vogt, L. A. Wessjohann, 2014), which could be applied for quantitative determination of the product caffeic acid (see FIG. 6). The inventors then assayed 4HPA3H under optimized conditions (see next section), yielding a specific activity (6.2±0.5 nmol min$^{-1}$ mg$^{-1}$) comparable to this from literature (Y. Lin, Y. Yan, *Microb. Cell Fact.* 2012, 11:42.). The two variants Y301F/S462A and Y301I—which were to also produced recombinantly (in yields of 147 and 112 mg l$^{-1}$ of culture, respectively) and applied as purified enzymes—showed reduced activities (1.6±0.3 nmol min$^{-1}$ mg$^{-1}$ and 1.3±0.6 nmol min$^{-1}$ mg$^{-1}$) towards p-coumaric acid (1 cf. FIG. 1). However, similar to the data obtained from whole-cell biotransformations (see Example 2), these variants were beneficial in the conversion of ferulic acid (3 cf. FIG. 1), which is also reflected by comparably high conversion rates (4HPA3H-Y301F/S462A: 1.06±0.31 nmol min$^{-1}$ mg$^{-1}$, 4HPA3H-Y301I: 4.49±0.20 nmol min$^{-1}$ mg$^{-1}$).

Example 5: In Vitro Production of Catechols by 4HPA3H/PrnF

Figure 7:
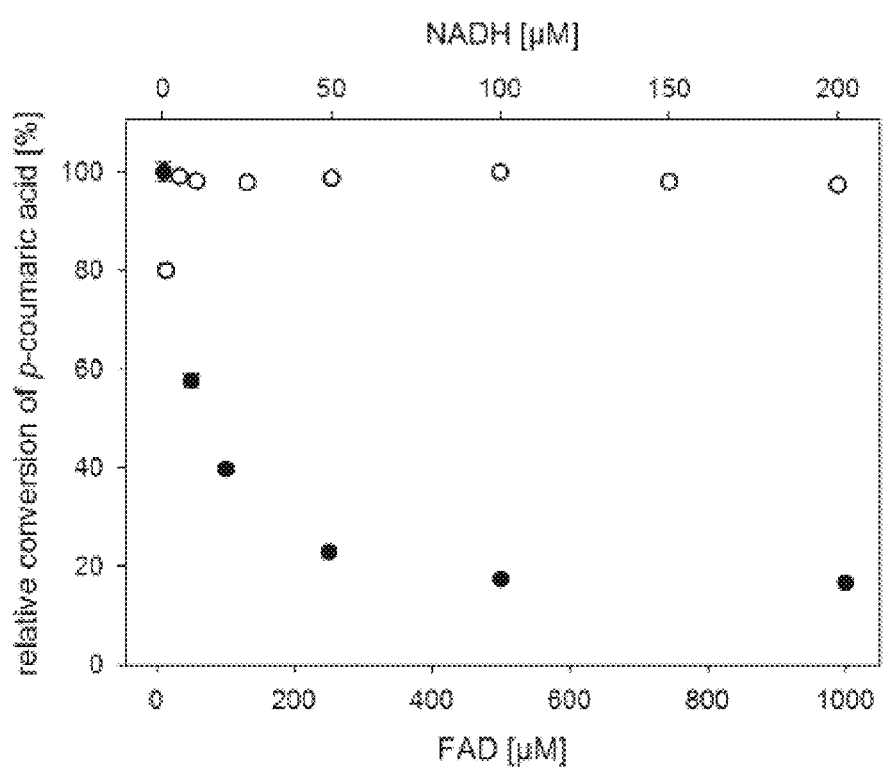
FIG. 7 shows the dependence of the in vitro conversion of p-coumaric acid on the FAD (filled circles) and NADH concentration (open circles). The reactions were to performed using the 4HPA3H/PrnF/FDH system.

In a multitude of biocatalytic conversions, cell-free (in vitro) systems proved to be suitable, especially with emphasis on substrate depletion by and toxicity to the used microorganism, side reactions, and facile product purification. In order to develop an effective and low-cost enzyme system for in vitro hydroxylation, several parameters of the 4HPA3H reaction with respect to maximum reaction rate were optimized. By means of a spectrophotometric assay (Example 4 above), the inventors screened different buffer systems and optimized the concentration of the components p-coumaric acid (1 cf. FIG. 1), FAD, NADH and methanol, the incubation temperature and oxygen transfer (i.e. by variation of the shaking frequency) (optimum conditions are given in the Experimental Section). In particular, this fine-tuning yielded (I) a reduction in the content of NADH from 200 µm (standard conditions according to reference) to 25 µm without loss of activity (see Fig. S4 in Supporting Information), (II) tolerance of high concentrations of substrate (1 mm) and (III) of the co-solvent methanol (10%, v/v) (which is beneficial due to enhanced substrate solubility). In contrast, the redox system was susceptible to high concentrations of FAD which proved to be inhibitory (see FIG. 7). In contrast to the cofactors, the accompanying cofactor recycling redox enzymes PrnF and FDH were used in excess due to their high specific activity.

Figure 8A:
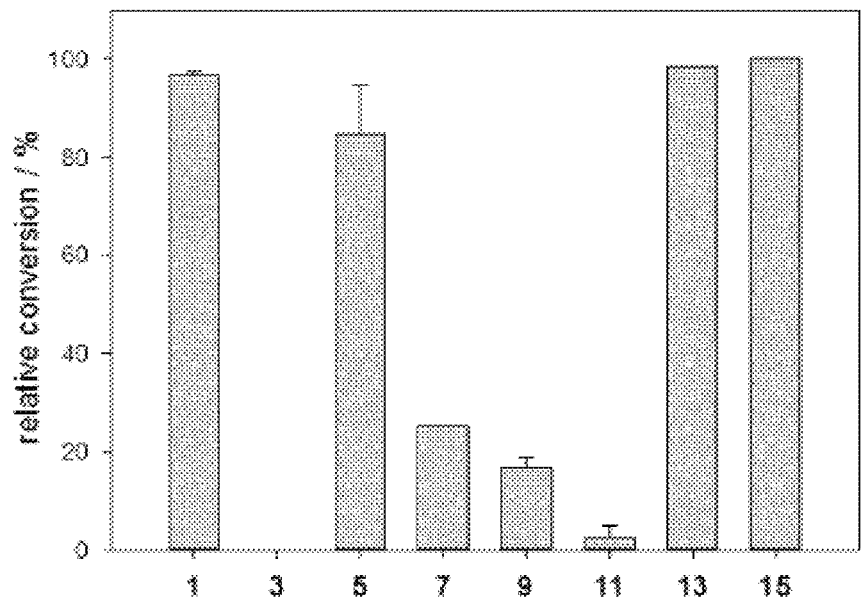
FIG. 8 shows the in vitro hydroxylation by the 4HPA3H/PrnF/FDH system. Purified 4HPA3H (A) or variants (B) (Y301I depicted in white and Y301F/S462A depicted in black) were used for conversion of substrates (1 mM) under optimized conditions. The numbers correspond to substrates as explained in the legend for FIG. 1 above.
Figure 8B:
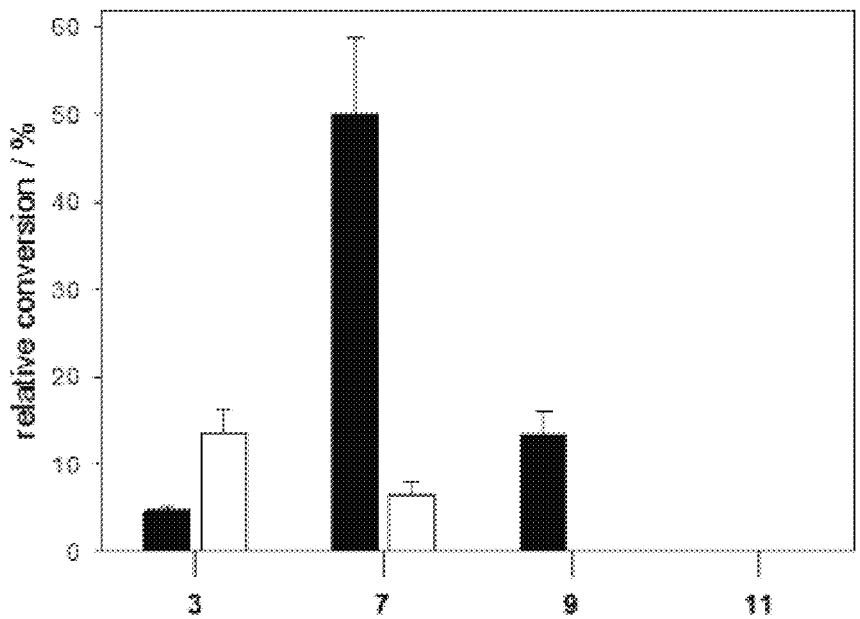

Subsequently, the optimized reaction conditions were applied to the in vitro oxidation of the substrates shown in FIG. 1. In accordance with the whole-cell transformation experiments (FIG. 3), product yields in the conversion by the wild-type 4HPA3H (FIG. 8A) ranged from high (1, 13, 15 cf. FIG. 1) or moderate (5 cf. FIG. 1) to low (9, 11 cf. FIG. 1), whereas ferulic acid 3 was not oxidized. Consistently, the mutant enzymes Y301F/S462A and Y301I (FIG. 8B) proved to be optimal for transformation of the challenging substrates 3 and 7. However, in contrast to the experiments with life biocatalysts low conversion of naringenin (7 cf. FIG. 1) by the wild-type 4HPA3H (25% yield) was observed (which might be explained by increased substrate availability). The hydroxycarbazole (11) was not accepted by the double variant Y301F/S462A, probably because of the high substrate concentration which seems to reflect strong product inhibition—an effect which has previously been observed for other 4HPA3H enzymes. Noteworthy, HPLC analysis of the reaction products confirmed product specificity.

Figure 9:
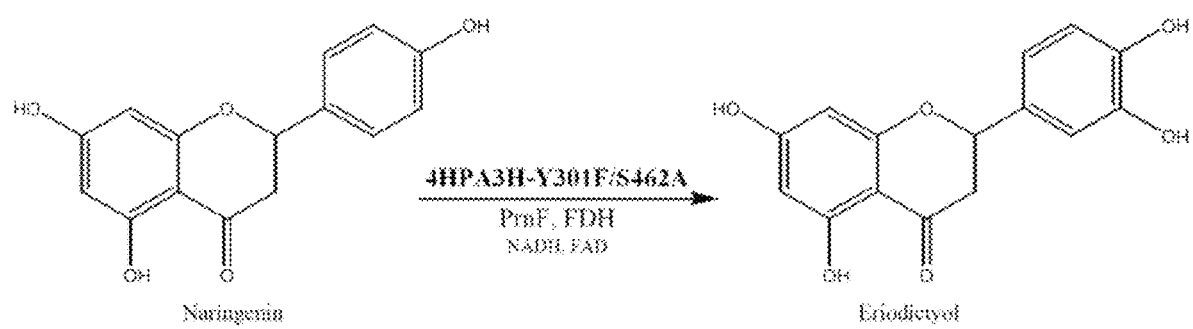
FIG. 9 shows the structure of naringenin and eriodictyol and one exemplary enzyme 4HPA3H Y301F/S462A catalyzing the hydroxylation of naringenin in the presence of cofactors and optionally the cofactor recycling enzymes PrnF and FDH.

Example 6: Hydroxylation of Naringenin to Eriodictyol Using a Solid Phase-Based Cascade System Stock solutions of naringin and eriodictyol (10 mM each) in methanol were produced (for the structure of the compounds, see FIG. 9). They were diluted using acetonitrile for obtaining the desired concentrations (70, 110, 140, 210 and 280 µM). 10 µl of each sample was injected in to a HPLC machine and calibration curves were produced for both substances (data not shown).

First the catalysis was performed using 9 mU oxidase 4HPA3H in a 10 ml reaction comprising 1 ml 1M Tris/HCl, pH 7.5; 25 µl of a 10 mM NADH solution, 20 µl of a 5 mM FAD solution and 1 ml formate solution using 9 mU 4HPA3H-Y301F/S462A (SEQ ID NO:175) and 0.57 mU PrnF-reductase (SEQ ID NO:176) and 640 mU FDH (SEQ ID NO:177). Subsequently the enzymes were mixes, 100 µl 1M Tris/HCl solution, pH 7.5, was added and ddH$_2$O (deionized, reverse osmosis) was added ad 2 ml. The enzyme solution was at least 5 times passed through a 1 ml Talon column with a flow rate of 0.1 ml/min$^{-1}$ to let the proteins bind to the column in a homogenous way. The evaluation of the complete binding of the proteins to the column material was measured via Bradford assay. Then, the column was washed once with 50 mM Tris/HCl, pH 7.5 (=basis buffer), and connected to a peristaltic pump. FIG. 4B shows the purified enzymes as used for the in vitro biocatalytical approach.

Figure 10:
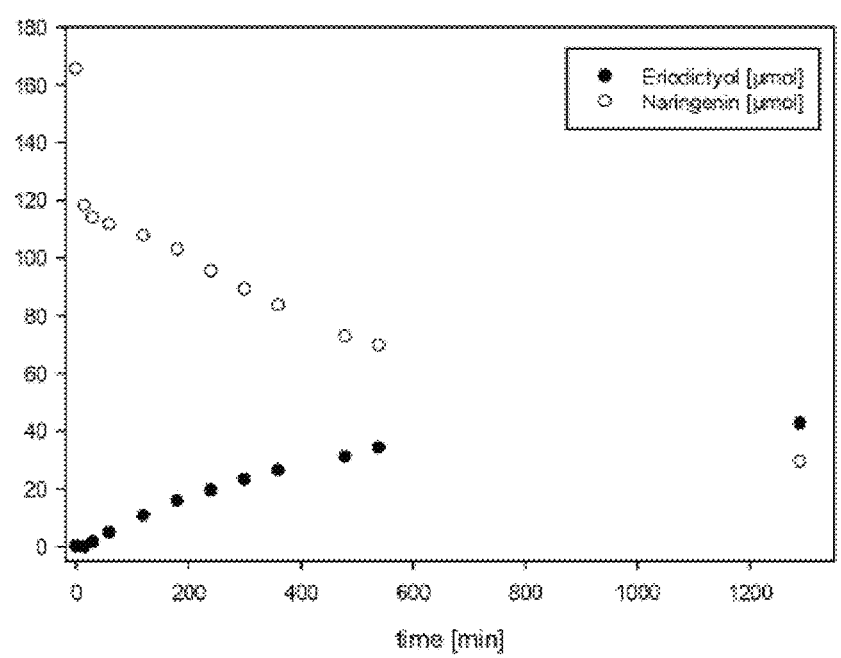
FIG. 10 shows the conversion of naringenin to eriodictyol by the 4HPA3H variant Y301F/S462A (9 mU) enzyme over the time as obtained by a cell-free biocatalytic approach using the enzyme immobilized on a carrier (Talon $Co^{2+}$ column).

The constituents of each reaction mixture were transferred to a suitable sterile flask, which was then connected to a peristaltic pump. During reaction, the reaction mixture was slightly stirred with the help of a magnetic stirrer. Using a flow rate of 1 ml/min, the system was washed with the basis buffer for 2 min and a control sample was taken. Only then, the substrate was added, here 200 µM naringenin (from a 10 mM stock solution in methanol). The substrate was pumped over the Talon column having the enzymes bound thereto with a flow rate of 1 ml/min at maximum. During the time range from 0-1310 min, the sample extraction was performed in samples of 35 µl each. Said samples were mixed with an equal volume of acetonitrile and were immediately injected into a HPLC device (20 µl each). The evaluation was conducted with the help of a calibration curve done at the beginning of the experiment and thereby measuring and calculating the peak areas (see FIG. 10). Using 9 mU 4HPA3H-Y301F/S462A (SEQ ID NO:175) after 1290 min, the biocatalytic formation of 42.4 µM eriodictyol and a remaining concentration of 29.3 µM naringenin could be confirmed which corresponds to a yield of >12.2 mg (>21.2%) using 9 mU/1 ml column volume of the catalyst after 21.5 h.

Figure 11:
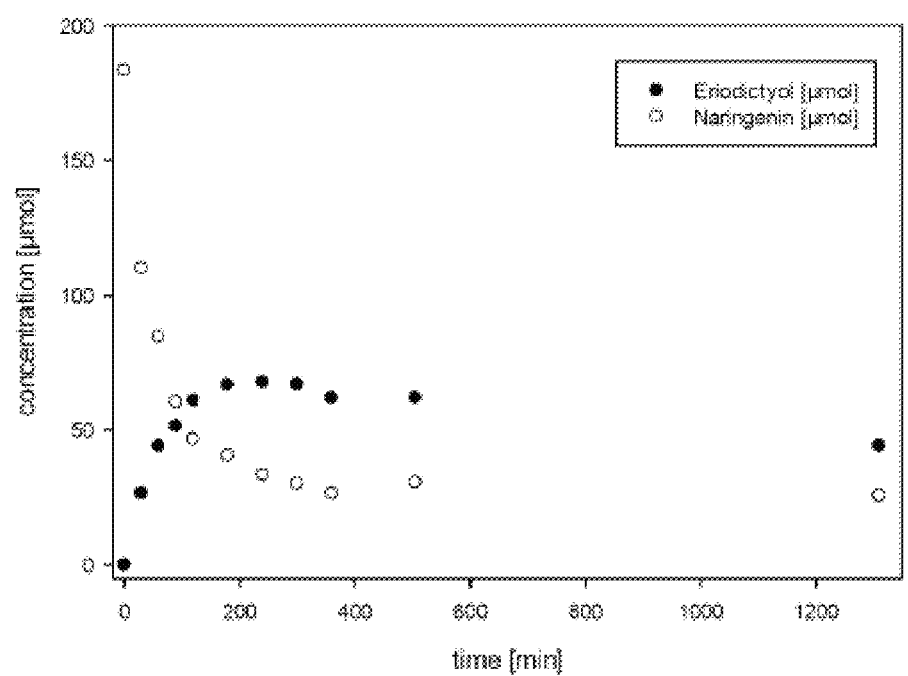
FIG. 11 shows the conversion of naringenin to eriodictyol by the 4HPA3H variant Y301F/S462A (35 mU) enzyme over the time as obtained by a cell-free biocatalytic approach using the enzyme immobilized on a carrier (Talon $Co^{2+}$ column)

The same assay was performed using 35 mU hydroxylase/1 ml column volume and the concentration of the co-enzymes for regeneration of the cofactor was increased equivalently. As also evident from FIG. 11, this catalysis yielded 67.7 µM eriodictyol and a to remaining concentration if 33.3 µM naringenin already after 240 min., which means that in a time of below 4 h>19.5 mg (>33.8%) product could be yielded, whereas the total yield is still higher.

It was further observed that eriodictyol might have the capability to stick to the Co$^{2+}$ ions of the Talon column reactive groups used for interaction with, e.g. a HIS-tagged protein/enzyme of interest. It is thus recommended and within the skills of a person having skill in the art to define the right way of coupling the enzymes to a specific column, to avoid unspecific binding of an educt/product either to the reactive tag on a column or the column material/resin to further increase the yield of an in vitro biocatalytic process according to the present invention.

Figure 12A:
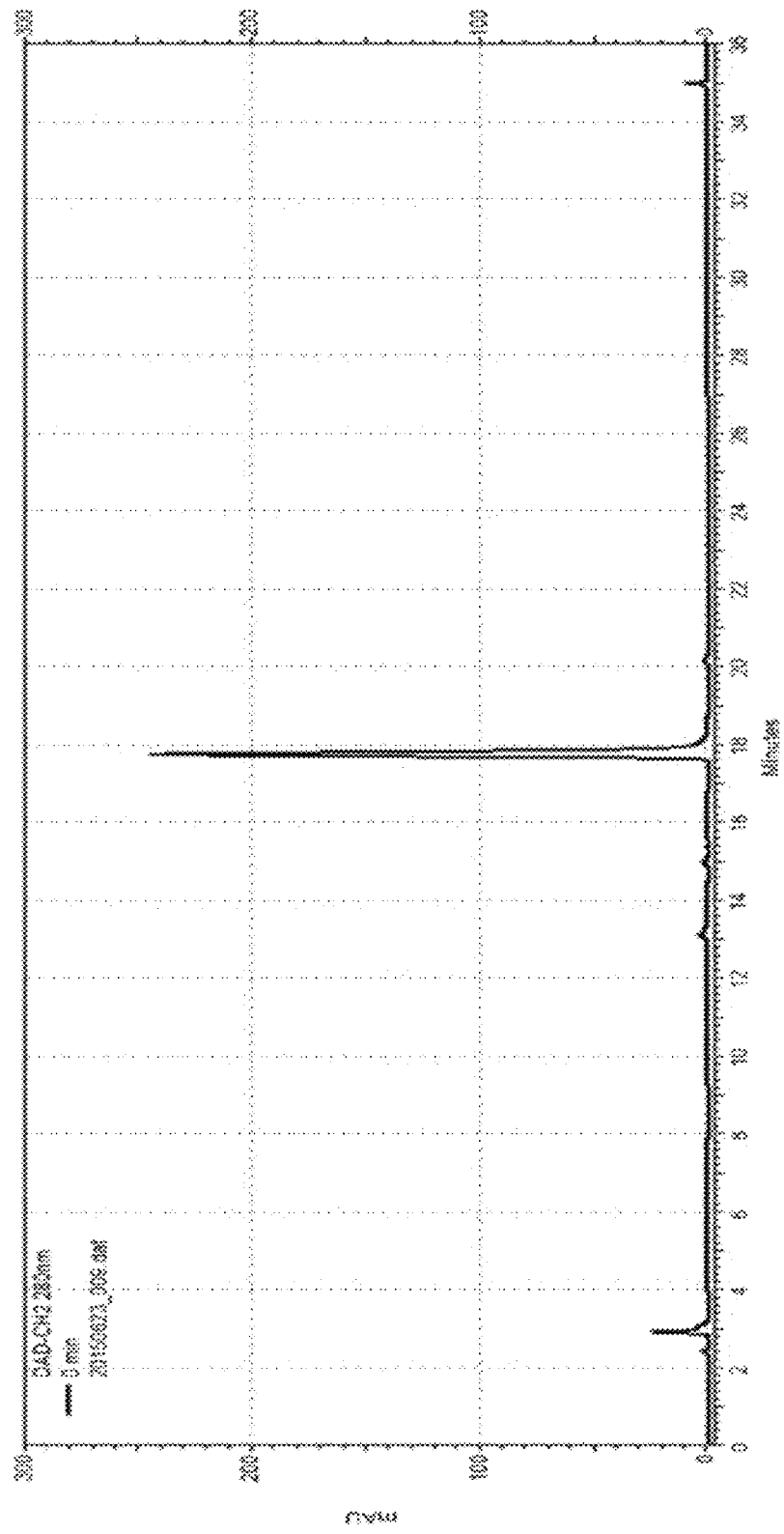
FIG. 12 shows (A) an HPLC-chromatogram at the timepoint "0" min of the solid phase-based cascade reaction as detailed in Example 12. Only the naringenin educt peak can be detected before starting the biocatalytic conversion.
Figure 12B:
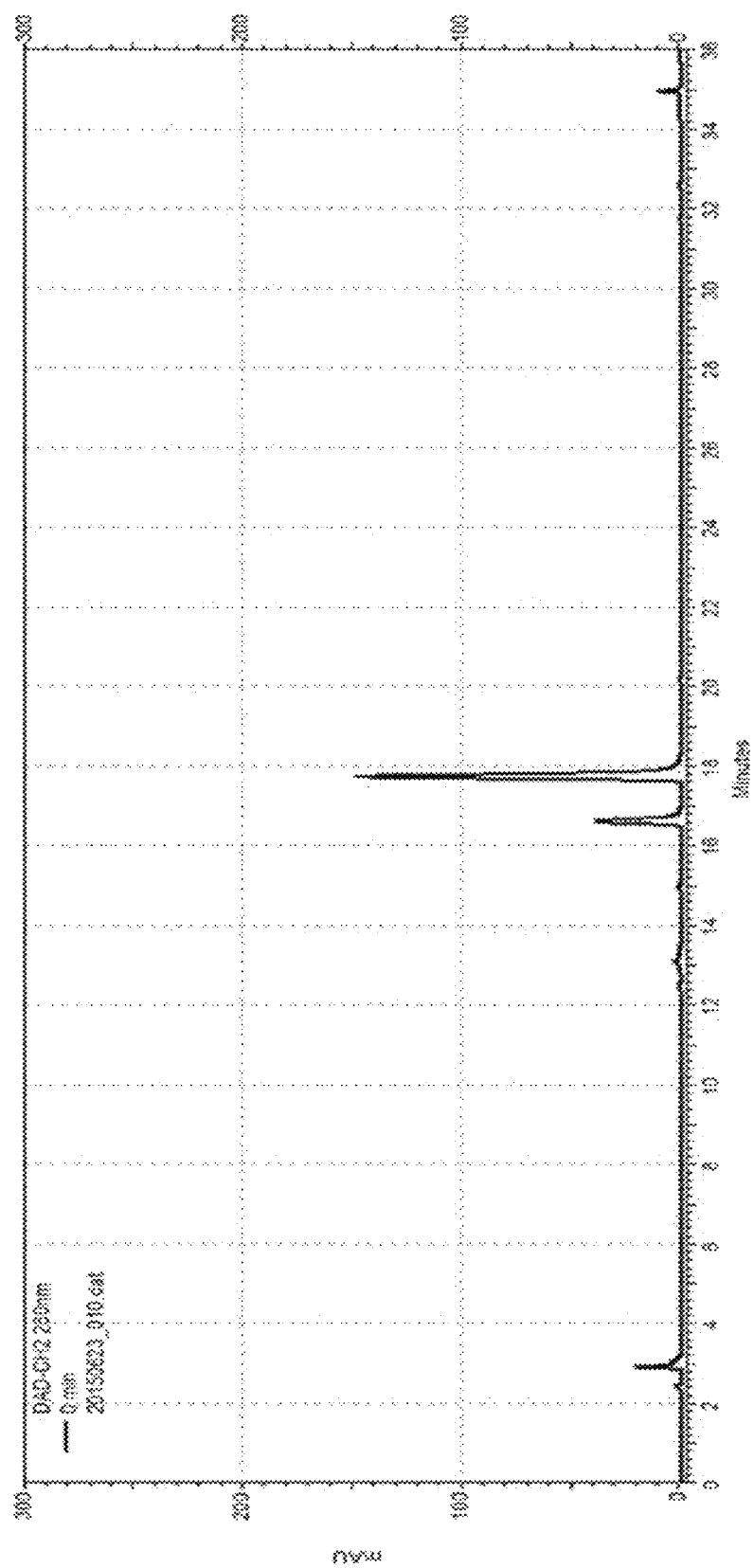
Figure 12C:
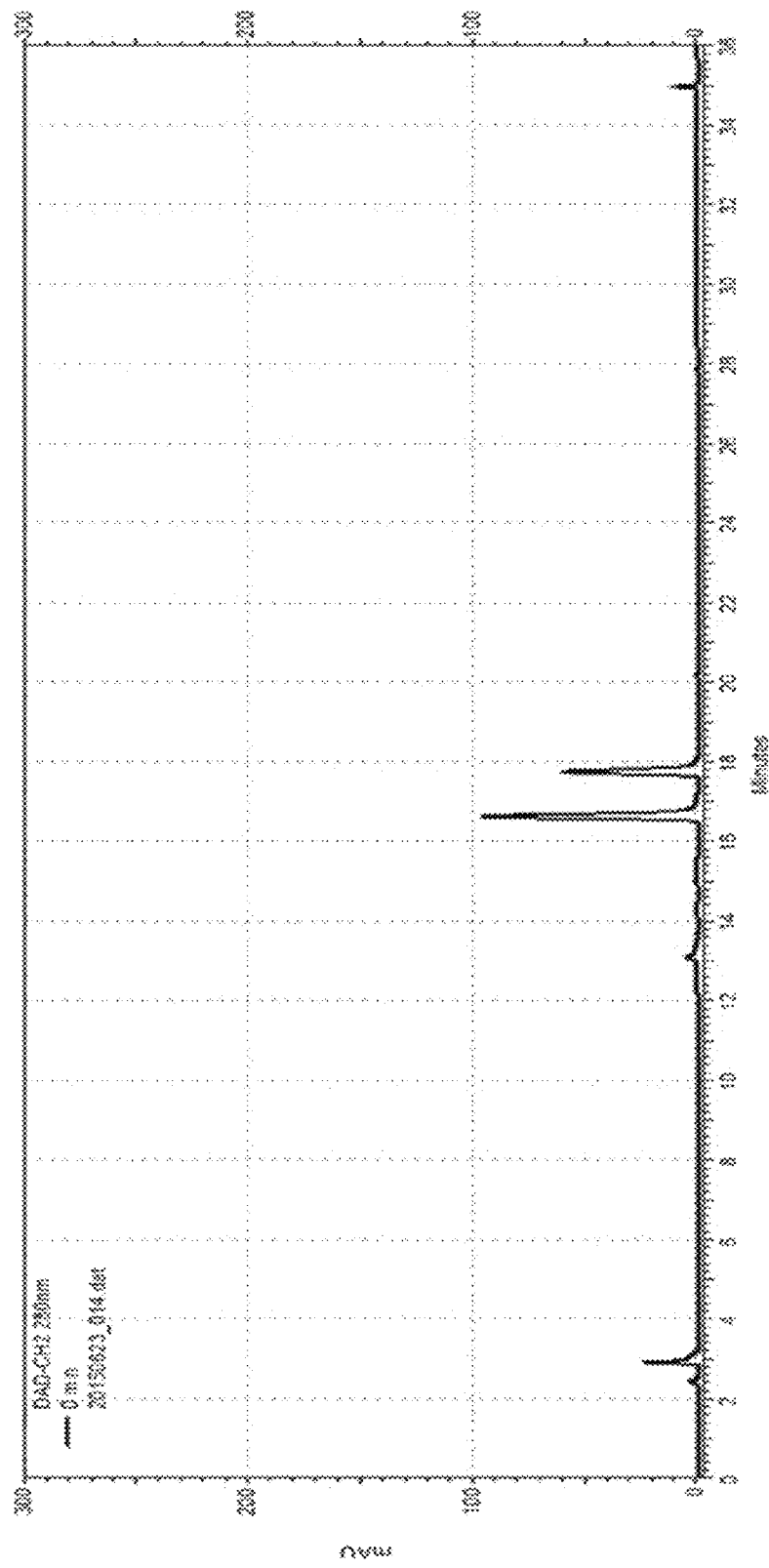

Remarkably, the biocatalytic in vitro process detailed above for a concentration of 9 mU and 35 mU of the oxidase showed a pronounced high regio- and substrate specificity yielding exclusively the desired products without any detectable side products (see FIG. 12). Already after 30 min reaction time, a product peak attributable to eriodictyol can be detected (see FIG. 12 (B)). Already after 240 min, there is a pronounced eriodictyol peak (see FIG. 12 (C)), whereas the reaction can easily be prolonged and the reaction conditions (buffer composition, enzyme concentration, flow rate, inclusion of a pause/stationary interaction phase) to achieve an even higher naringenin to eriodictyol ratio from up to 1:100. As evident, when comparing FIG. 12 (A) to FIG. 12 (C) small peaks, which can still be recognized in the chromatogram were already present in the solution at the timepoint "0" at the begin of the reaction before any substrate conversion proving that said side products were not the result of the oxidase system used, but rather peaks resulting from the molecules contained in the starting buffer/solution. This is indicative of a highly specific and efficient reaction yielding no side products, especially no further oxidized products, than the product eriodictyol.

Example 7: Combined Two-Step Biotechnological Generation of Further Methylated 3,4-Dihydroxyphenol Compound To further test the applicability of the biotechnological method using a genetically engineered oxidase from *E. coli* for its reliable and versatile use in the production of methylated 3,4-dihydroxyphenol compounds, especially flavonoids, a vector system was designed comprising pET28+ (for *E. coli*) and the shuttle vector pD1214 (for *S. cerevisia*) and carrying a 3' or 4'O-methyltransferase coding region (see e.g. SEQ ID NOs:87 to 89 and 193 to 197) or both as well as a coding region for a 4HPA3H enzyme (see, e.g. SEQ ID NOs:1 to 79), either on the same or on a different vector for cotransformation. Additionally, several constructs were created, wherein the 4HPA3H variants were cloned into different expression vectors to equip them with different protein tags for subsequent to purification and/or immobilization for in vitro catalytical approaches. Furthermore, tag-free variants were generated. Concerning in vivo assays, depending on the type of host cell, also a cofactor recycling enzymes was coexpressed with the aforementioned enzymes.

After verification of functional protein expression in vivo and (after purification of the necessary enzymes) in vitro assays were performed which integrated both steps of the enzyme cascade, i.e. first the oxidation of a 4-hydroxyphenol to a 3,4-dihydroxyphenol compound and then the further methylation of the thus obtained intermediate to a further methylated compound with methylations at the 3' or 4' position or both.

Figure 13:
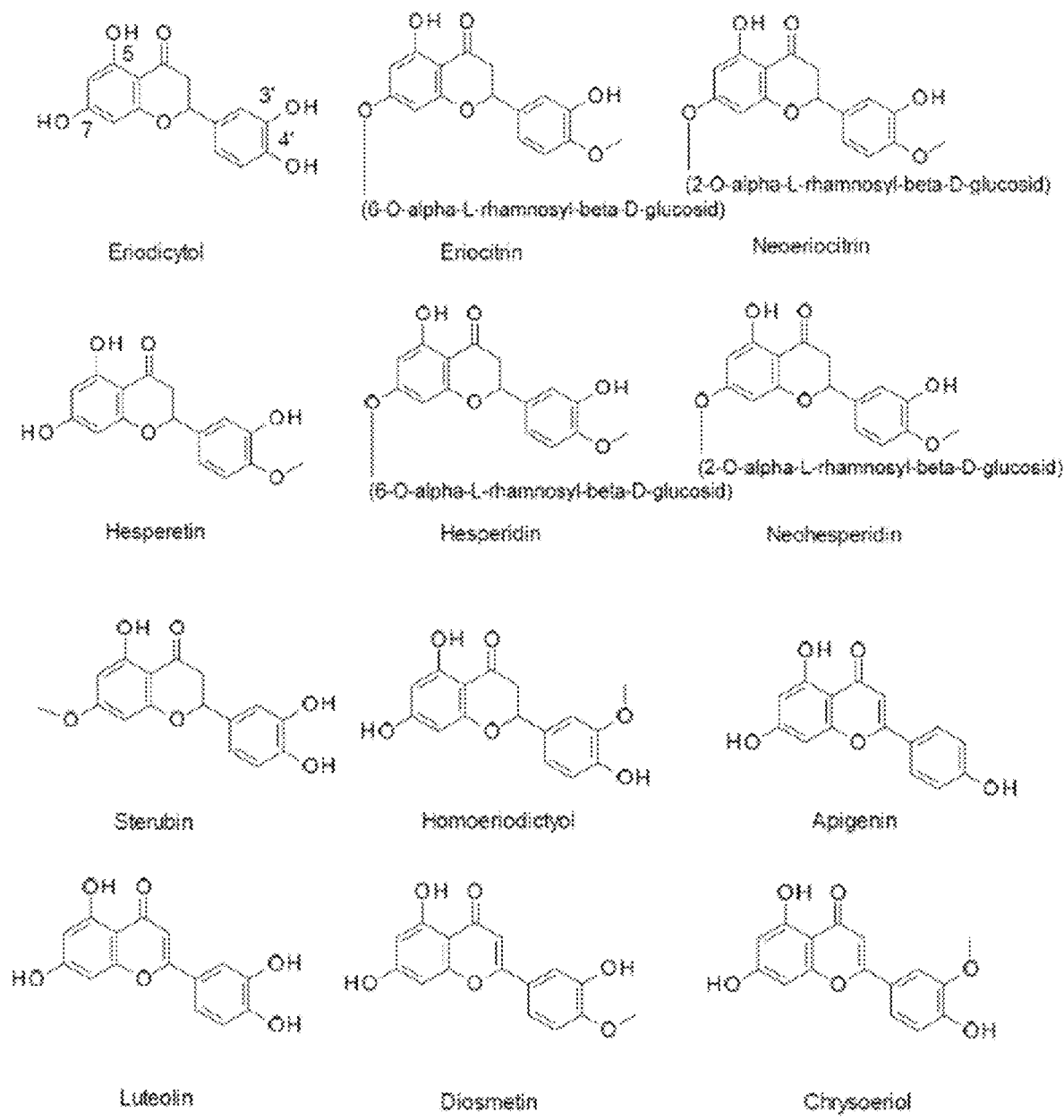
FIG. 13 shows several flavonoid compounds, including eriodictyol, hesperetin, and glycosides thereof, and homoeriodictyol.

For in vivo testing, suspensions of *E. coli* BL21(DE3) cells were tested for hydroxylation of a panel of several phenolic compounds as detailed above in Example 2. A specific focus was laid on the optimization for the protocol using naringenin as starting substance yielding hesperetin (see FIG. 13), when simultaneously providing a 4HPA3H enzyme and a 4-O-methyltransferase or yielding homoeriodictyol when providing a 4HPA3H enzyme and a 3-O-methyltransferase. Naringenin could be added to the shaking culture comprising the transformed host cell carrying a plasmid for producing 4HPA3H and a suitable O-methyltransferase. In view of the successful provision of this in vivo system, further experiments will be conducted by replacing the staring material and the O-methyltransferase, as the mechanism elucidated by the present work can easily be adapted to a wide range of 3-hydroxyphenyl compounds accepted by the active site of the 4HPA3H enzyme, which can readily be converted into a 3,4-dihydroxyphenol compound and subsequently be tailor-made methylated at a desired position using a suitable O-methyltransferase.

The same assay, after purification of the 4HPA3H variants and the respective O-methyltransferase, was repeated as in vitro biocatalytic assay providing these enzymes as well as suitable cofactor recycling enzymes (see Example 6) for the substrate naringenin. Here, a two-step procedure had to be applied, whereas step 1 of this procedure was conducted as detailed in Example 6. The educt of step 1 was then subjected to a further round of derivatization using a column having an O-methyltransferase non-covalently attached thereto. Further experiments were done using an immobilized enzyme. The eluate of step 1 was then transferred to the column having the O-methyltransferase bound thereto. The buffer system for the interaction was chosen in a range to be optimal for the catalytic activity of the O-methyltransferase. The following buffers according to Table 1 were tested:

TABLE 1

| Buffer |
| --- |
| 50 mM Tris-HCl, pH 8.8 with 2 mM MgCl$_2$ |
| 50 mM Tris-HCl, pH 7.5 |
| 100 mM KPi pH 7.5 with 140 µM MgCl$_2$ |
| 10 mM HEPES, pH 7.2 with 100 µM MgCl2 |
| 100 mM HEPES pH 7.7 |
| 50 mM NaH2PO4 pH 8.0 with 300 mM NaCl |
| 100 mM KPi pH 7.5 |
| 50 mM Tris-HCl, pH 7.6 |

Additionally, this enzymatic biocatalytic approach performed ex vivo demanded the addition of S-adenosylmethionine to the buffer, which served as cofactor for the O-methyltransferase. Optimized buffer conditions can be determined depending on the O-methyltransferase of interest. The above assay yielded hesperetin and homoeriodictyol in sufficient amounts and purities to plan industrial scale applications based on this method. It is also envisaged to introduce a third step, in case a further methylation should be introduced into a substrate of interest, which can be conducted as step 2 taking into account the peculiarities as demanded by the O-methyltransferase of interest, which, however, can be readily determined in routine pre-experiments.

It is evident that the 4HPA3H variant as used in this experiment for in vivo or in vitro catalyzing the introduction of a hydroxylation at the 3' position of the 4-hydroxyphenyl compound as substrate can likewise be exchanged against another enzyme, which can be achieved by using this different enzyme and applying the same in the biotechnological methods as provided with this work, which elucidates the responsible sequence of biocatalytic steps.

SEQUENCE LISTING (202 sequences)

SEQ ID NO: 1 - DNA, 1563 bp, Escherichia coli
  4HPA3H HpaB wt
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 2 - DNA, 1563 bp, Escherichia coli
  4HPA3H HpaB I157A
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcggcggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 3 - DNA, 1563 bp, Escherichia coli 4HPA3H HpaB I157C
  4HPA3H HpaB I157C
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgtgcgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 4 - DNA, 1563 bp, Escherichia coli
  4HPA3H HpaB I157D
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcggatgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 5 - DNA, 1563 bp, Escherichia coli
  4HPA3H HpaB I157E
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcggaagttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 6 - DNA, 1563 bp, Escherichia coli
  4HPA3H HpaB I157F
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgtttgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 7 - DNA, 1563 bp, Escherichia coli
  4HPA3H HpaB I157G
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgggcgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 8 - DNA, 1563 bp, Escherichia coli
  4HPA3H HpaB I157H
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgcatgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 9 - DNA, 1563 bp, Escherichia coli
  4HPA3H HpaB I157K
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgaaagttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 10 - DNA, 1563 bp, Escherichia coli
  4HPA3H HpaB I157L
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgttagttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 11 - DNA, 1563 bp, Escherichia coli
  4HPA3H HpaB I157M
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgatggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 12 - DNA, 1563 bp, Escherichia coli
  4HPA3H HpaB I157N
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgaacgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 13 - DNA, 1563 bp, Escherichia coli
  4HPA3H HpaB I157P
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgccggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 14 - DNA, 1563 bp, Escherichia coli
  4HPA3H HpaB I157Q
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgcaggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 15 - DNA, 1563 bp, Escherichia coli
  4HPA3H HpaB I157R
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgcgcgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 16 - DNA, 1563 bp, Escherichia coli
  4HPA3H HpaB I157S
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgagcgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 17 - DNA, 1563 bp, Escherichia coli
  4HPA3H HpaB I157T
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgaccgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 18 - DNA, 1563 bp, Escherichia coli
  4HPA3H HpaB I157V
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcggtggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 19 - DNA, 1563 bp, Escherichia coli
  4HPA3H HpaB I157W
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgtgggttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 20 - DNA, 1563 bp, Escherichia coli
  4HPA3H HpaB I157Y
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgtatgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 21 - DNA, 1563 bp, Escherichia coli
  4HPA3H HpaB M293A
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacggcggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 22 - DNA, 1563 bp, Escherichia coli
  4HPA3H HpaB M293C
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgtgcgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 23 - DNA, 1563 bp, Escherichia coli
  4HPA3H HpaB M293D
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacggatgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 24 - DNA, 1563 bp, Escherichia coli
  4HPA3H HpaB M293E
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacggaagaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 25 - DNA, 1563 bp, Escherichia coli
  4HPA3H HpaB M293F
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgtttgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 26 - DNA, 1563 bp, Escherichia coli
  4HPA3H HpaB M293G
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgggcgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 27 - DNA, 1563 bp, Escherichia coli
  4HPA3H HpaB M293H
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgcatgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 28 - DNA, 1563 bp, Escherichia coli
  4HPA3H HpaB M293I
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgattgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 29 - DNA, 1563 bp, Escherichia coli
  4HPA3H HpaB M293K
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgaaagaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 30 - DNA, 1563 bp, Escherichia coli
  4HPA3H HpaB M293L
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgttagaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 31 - DNA, 1563 bp, Escherichia coli
  4HPA3H HpaB M293N
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgaacgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 32 - DNA, 1563 bp, Escherichia coli
  4HPA3H HpaB M293P
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgccggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 33 - DNA, 1563 bp, Escherichia coli
  4HPA3H HpaB M293Q
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgcaggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 34 - DNA, 1563 bp, Escherichia coli
  4HPA3H HpaB M293R
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgcgcgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 35 - DNA, 1563 bp, Escherichia coli
  4HPA3H HpaB M293S
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgagcgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 36 - DNA, 1563 bp, Escherichia coli
  4HPA3H HpaB M293T
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgaccgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 37 - DNA, 1563 bp, Escherichia coli
  4HPA3H HpaB M293V
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacggtggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 38 - DNA, 1563 bp, Escherichia coli
  4HPA3H HpaB M293W
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgtgggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 39 - DNA, 1563 bp, Escherichia coli
  4HPA3H HpaB M293Y
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgtatgaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 40 - DNA, 1563 bp, Escherichia coli
  4HPA3H HpaB Y301A
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatggcgccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 41 - DNA, 1563 bp, Escherichia coli
  4HPA3H HpaB Y301C
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtgcccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 42 - DNA, 1563 bp, Escherichia coli
  4HPA3H HpaB Y301D
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatggatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 43 - DNA, 1563 bp, Escherichia coli
  4HPA3H HpaB Y301E
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatggaaccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 44 - DNA, 1563 bp, Escherichia coli
  4HPA3H HpaB Y301F
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtttccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 45 - DNA, 1563 bp, Escherichia coli
  4HPA3H HpaB Y301G
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgggcccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 46 - DNA, 1563 bp, Escherichia coli
  4HPA3H HpaB Y301H
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgcatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 47 - DNA, 1563 bp, Escherichia coli
  4HPA3H HpaB Y301I
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgattccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 48 - DNA, 1563 bp, Escherichia coli
  4HPA3H HpaB Y301K
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgaaaccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 49 - DNA, 1563 bp, Escherichia coli
  4HPA3H HpaB Y301L
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgttaccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 50 - DNA, 1563 bp, Escherichia coli
  4HPA3H HpaB Y301M
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgatgccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 51 - DNA, 1563 bp, Escherichia coli
  4HPA3H HpaB Y301N
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgaacccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 52 - DNA, 1563 bp, Escherichia coli
  4HPA3H HpaB Y301P
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgccgccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 53 - DNA, 1563 bp, Escherichia coli
  4HPA3H HpaB Y301Q
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgcagccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 54 - DNA, 1563 bp, Escherichia coli
  4HPA3H HpaB Y301R
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgcgcccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 55 - DNA, 1563 bp, Escherichia coli
  4HPA3H HpaB Y301S
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgagcccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 56 - DNA, 1563 bp, Escherichia coli
  4HPA3H HpaB Y301T
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgaccccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 57 - DNA, 1563 bp, Escherichia coli
  4HPA3H HpaB Y301V
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatggtgccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 58 - DNA, 1563 bp, Escherichia coli
  4HPA3H HpaB Y301W
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtggccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 59 - DNA, 1563 bp, Escherichia coli
  4HPA3H HpaB S462A
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgcgggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 60 - DNA, 1563 bp, Escherichia coli
  4HPA3H HpaB S462C
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactgcggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 61 - DNA, 1563 bp, Escherichia coli
  4HPA3H HpaB S462D
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgatggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 62 - DNA, 1563 bp, Escherichia coli
  4HPA3H HpaB S462E
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgaaggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 63 - DNA, 1563 bp, Escherichia coli
  4HPA3H HpaB S462F
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactttggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 64 - DNA, 1563 bp, Escherichia coli
  4HPA3H HpaB S462G
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacggcggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 65 - DNA, 1563 bp, Escherichia coli
  4HPA3H HpaB S462H
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactaccatggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 66 - DNA, 1563 bp, Escherichia coli
  4HPA3H HpaB S462I
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacattggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 67 - DNA, 1563 bp, Escherichia coli
  4HPA3H HpaB S462K
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacaaaggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 68 - DNA, 1563 bp, Escherichia coli
  4HPA3H HpaB S462L
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacttaggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 69 - DNA, 1563 bp, Escherichia coli
  4HPA3H HpaB S462M
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacatgggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 70 - DNA, 1563 bp, Escherichia coli
  4HPA3H HpaB S462N
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacaacggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 71 - DNA, 1563 bp, Escherichia coli
  4HPA3H HpaB S462P
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacccgggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 72 - DNA, 1563 bp, Escherichia coli
  4HPA3H HpaB S462Q
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactaccagggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 73 - DNA, 1563 bp, Escherichia coli
  4HPA3H HpaB S462R
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactaccgcggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 74 - DNA, 1563 bp, Escherichia coli
  4HPA3H HpaB S462T
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacaccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 75 - DNA, 1563 bp, Escherichia coli
  4HPA3H HpaB S462V
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgtgggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 76 - DNA, 1563 bp, Escherichia coli
  4HPA3H HpaB S462W
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactggggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 77 - DNA, 1563 bp, Escherichia coli
  4HPA3H HpaB S462Y
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtatccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactactatggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 78 - DNA, 1563 bp, Escherichia coli
  4HPA3H HpaB Y301F/S462A
atgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtttccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataa

SEQ ID NO: 79 - DNA, 6856 bp, Artificial Sequence
  pet28b-HpaB_Y301F_S462A
tggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcaggtggcacttttcggggaaatgtgcgcggaacccctatttgtttatttttctaaatacattcaaatatgtatccgctcatgaattaattcttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctagagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgagatcccggtgcctaatgagtgagctaacttacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacgcgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtccgggatctcgacgctctcccttatgcgactcctgcattaggaagcagcccagtagtaggttgaggccgttgagcaccgccgccgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatcgagatctcgatcccgcgaaattaatacgactcactataggggaattgtgagcggataacaattcccctctagaaataattttgtttaactttaagaaggagatataccatgggcagcagccatcatcatcatcatcacagcagcggcctggtgccgcgcggcagccatatgaaaccagaagatttccgcgccagtacccaacgtcctttcaccggggaagagtatctgaaaagcctgcaggatggtcgcgagatctatatctatggcgagcgagtgaaagacgtcaccactcatccggcatttcgtaatgcggcagcgtctgttgcccagctgtacgacgcactgcacaaaccggagatgcaggactctctgtgttggaacaccgacaccggcagcggcggctatacccataaattcttccgcgtggcgaaaagtgccgacgacctgcgccagcaacgcgacgccatcgctgagtggtcacgcctgagctatggctggatgggccgtaccccagactacaaagccgctttcggttgcgcactgggcgcgaatccgggcttttacggtcagttcgagcagaacgcccgtaactggtacacccgtattcaggaaactggcctctactttaaccacgcgattgttaacccaccgatcgatcgtcatttgccgaccgataaagtgaaagacgtttacatcaagctggaaaaagagactgacgccgggattatcgtcagcggtgcgaaagtggttgccaccaactcggcgctgactcactacaacatgattggcttcggctcggcacaagtgatgggcgaaaacccggacttcgcactgatgttcgttgcgccaatggatgccgatggcgtgaaattaatctcccgcgcctcttatgagatggtcgcgggtgctaccggctcgccatacgactacccgctctccagccgcttcgatgagaacgatgcgattctggtgatggataacgtgctgattccatgggaaaacgtgctgatctaccgcgattttgatcgctgccgtcgctggacgatggaaggcggttttgcccgtatgtttccgctgcaagcctgtgtgcgcctggcagtgaaattagacttcattacggcactgctgaaaaaatcactcgaatgtaccggcaccctggagttccgtggtgtgcaggccgatctcggtgaagtggtagcgtggcgcaacaccttctgggcattgagtgactcgatgtgttcagaagcaacgccgtgggtcaacggggcttatttaccggatcatgccgcactgcaaacctatcgcgtactggcaccaatggcctacgcgaagatcaaaaacattatcgaacgcaacgttaccagtggcctgatctatctcccttccagtgcccgtgacctgaataatccgcagatcgaccagtatctggcgaagtatgtgcgcggttcgaacggtatggatcacgtccagcgcatcaagatcctcaaactgatgtgggatgctattggcagcgaatttggtggtcgtcacgaactgtatgaaatcaactacgccggtagccaggatgagattcgcctgcagtgtctgcgccaggcacaaaactccggcaatatggacaagatgatggcgatggttgatcgctgcctgtcggaatacgaccaggacggctggactgtgccgcacctgcacaacaacgacgatatcaacatgctggataagctgctgaaataactcgagcaccaccaccaccaccactgagatccggctgctaacaaagcccgaaaggaagctgagttggctgctgccaccgctgagcaataactagcataaccccttggggcctctaaacgggtcttgaggggttttttgctgaaaggaggaactatatccggat

SEQ ID NO: 80 - DNA, 561 bp, Pseudomonas protegens
  flavin reductase PrnF
atgaatgctgccaccgaaaccaaagttcacgatttgctcgatgccgagggccgcgatgtccgcgatgcccgtgaactgcgcaacgtgctggggcagtttgctaccggtgtgaccgtgatcaccacccgcaccgcagacggccgcaacgtcggtgtgacggccaactcgttctcctcactgtcgctgtcaccggcgctggtgctctggagcctggcacgcacggcaccgagcctgaaggccttttgctcggcgagccacttcgccatcaacgtactgggcgcgcaccagcaccacctgtcggagcagttcgcacgggcagcagccgacaagttcgccggtgtagctcattcctatggcaaggcgggagccccggtgctggacgatgtggtggcagtgctggtgtgccgcaacgtcacccagtacgagggcggtgaccacctgatcttcattggcgagatcgaacaataccgctacagcggcgcagaaccgctggtcttccatgcaggccagtaccgggggctagggagcaatagagcagaaagcgtcctcaagcacgaatag

SEQ ID NO: 81 - DNA, 1131 bp, Candida boidinii formate dehydrogenase FDH
  formate dehydrogenase FDH
atgtcgaagggaaaggttttgctggttctttacgaaggtggtaagcatgctgaagagcaggaaaagttattggggtgtattgaaaatgaacttggtatcagaaatttcattgaagaacagggatacgagttggttactaccattgacaaggaccctgagccaacctcaacggtagacagggagttgaaagacgctgaaattgtcattactacgccctttttccccgcctacatctcgagaaacaggattgcagaagctcctaacctgaagctctgtgtaaccgctggcgtcggttcagaccatgtcgatttagaagctgcaaatgaacggaaaatcacggtcaccgaagttactggttctaacgtcgtttctgtcgcagagcacgttatggccacaattttggttttgataagaaactataatggtggtcatcaacaagcaattaatggtgagtgggatattgccggcgtggctaaaaatgagtatgatctggaagacaaaataatttcaacggtaggtgccggtagaattggatatagggttctggaaagattggtcgcatttaatccgaagaagttactgtactacgactaccaggaactacctgcggaagcaatcaatagattgaacgaggccagcaagcttttcaatggcagaggtgatattgttcagagagtagagaaattggaggatatggttgctcagtcagatgttgttaccatcaactgtccattgcacaaggactcaaggggtttattcaataaaaagcttatttcccacatgaaagatggtgcatacttggtgaataccgctagaggtgctatttgtgtcgcagaagatgttgccgaggcagtcaagtctggtaaattggctggctatggtggtgatgtctgggataagcaaccagcaccaaaagaccatccctggaggactatggacaataaggaccacgtgggaaacgcaatgactgttcatatcagtggcacatctctggatgctcaaaagaggtacgctcagggagtaaagaacatcctaaatagttacttttccaaaaagtttgattaccgtccacaggatattattgtgcagaatggttcttatgccaccagagcttatggacagaagaaataa

SEQ ID NO: 82 - DNA, 513 bp, Escherichia coli
  HpaC
atgcaattagatgaacaacgcctgcgctttcgtgacgcgatggccagcctgtcggcagcggtaaatattatcaccaccgagggcgacgccggacaatgcgggattacggcaacggccgtctgctcggtcacggatacaccaccgtcgctgatggtgtgcattaacgccaacagtgcgatgaacccggtttttcagggcaacggcaagttgtgcgtcaacgtcctcaaccatgagcaggaactgatggcacgccacttcgcgggcatgacaggcatggcgatggaagagcgttttagcctctcatgctggcaaaaaggtccgctggcgcagccggtgctaaaaggttcgctggccagtcttgaaggtgagatccgcgatgtgcaggcaattggcacacatctggtgtatctggtggagattaaaaacatcatcctcagtgcagaaggtcatggacttatctactttaaacgccgtttccatccggtgatgctggaaatggaagctgcgatttaa

SEQ ID NO: 83 - DNA, 1431 bp, Bacillus megaterium
  GDH
ttgataaaagctaaggttagtttacggcctattgttagtaaaataaatttacctactgtgttgaaaacagctatacttcctggggactcatttgaaagtttatttattgcaacccaagtaggagagatcttttacataagagacgaagctatacagacttttttagatattcgctcacgaatcataaaattaggtacgtctgaaccaggtgtttcccgcggaggatatgatgaacgaggattgctagggctagcgtttcatccagaattttattataatggtctgttttatcttcattactcagcagctggaacacaaggcccaggtgcactttccgaacattataggcctaacccgtgtgatcctaaaacttcaaacttaaggtggataaatagagaaactaaatatgatcatattgatacagtagaagaatgggttttccaaccaaatgctcagcctcaaaaaagacggacattacttaacttaagaagaccattttttaatcataatggtgtcaacagcttaaacttttcacctgaaactggaaaacttatctttacaaccggagatggtggatcaggctatgacccctttaacttaagtcaggatgatatagaaatttacgggaaaataattgaaattgatgtaggtaagaatacatttatccataatccacccgtagtcacacgttttagtgaactcccctcacctattcaggaaactcttacgctcattgcaaagggtgttcgcaatataacgggcatttcatttcaaaaattttataatcagtacatcaaatatgtgggaaatgttggacaagacgtagtagagtcgattttttcatttgttcattataagccaatacctgttcctcaacttgttcaagcttctttaatgagagccaaacccagccaagaaggatttattaaccttggctggaggggatgggaaggagattttccgacttcgtttataaaaaggtgttctgaaaatccggccttggatgagaaaataattgcttattacaatgaagcggtaaaaacttcagtgagacgtattcagcctttaacaagttattttcacaaagatccccgccccaataaatttggagggacctcccttacaggagttcagccatatatggggaataaaatctctagcttaacaggaagcgttatgtttacggatattgcacaggttaaagaacctcaatccccaattagaggagttttagcttataccagagcaggtacagattgtaagctaaatgattttagtgttgtagaagttgattataattttggttcccaatcagcttactacgttagtttgggaacgaacctggatcaaaccaggctttatttaggagtttatggctctatgaaagtgtctgactttaatcaaggtactgtttttgaaattgttccatga

SEQ ID NO: 84 - DNA, 1011 bp, Pseudomonas stutzeri
  PTDH
atgctgccgaaactcgttataactcaccgagtacacgatgagatcctgcaactgctggcgccacattgcgagctgatgaccaaccagaccgacagcacgctgacgcgcgaggaaattctgcgccgctgccgcgatgctcaggcgatgatggcgttcatgcccgatcgggtcgatgcagactttcttcaagcctgccctgagctgcgtgtagtcggctgcgcgctcaagggcttcgacaatttcgatgtggacgcctgtactgcccgcggggtctggctgaccttcgtgcctgatctgttgacggtcccgactgccgagctggcgatcggactggcggtggggctggggcggcatctgcgggcagcagatgcgttcgtccgctctggcgagttccagggctggcaaccacagttctacggcacggggctggataacgctacggtcggcatccttggcatgggcgccatcggactggccatggctgatcgcttgcagggatggggcgcgaccctgcagtaccacgaggcgaaggctctggatacacaaaccgagcaacggctcggcctgcgccaggtggcgtgcagcgaactcttcgccagctcggacttcatcctgctggcgcttcccttgaatgccgatacccagcatctggtcaacgccgagctgcttgccctcgtacggccgggcgctctgcttgtaaacccctgtcgtggttcggtagtggatgaagccgccgtgctcgcggcgcttgagcgaggccagctcggcgggtatgcggcggatgtattcgaaatggaagactgggctcgcgcggaccggccgcggctgatcgatcctgcgctgctcgcgcatccgaatacgctgttcactccgcacatagggtcggcagtgcgcgcggtgcgcctggagattgaacgttgtgcagcgcagaacatcatccaggtattggcaggtgcgcgcccaatcaacgctgcgaaccgtctgcccaaggccgagcctgccgcatgttga

SEQ ID NO: 85 - DNA, 1461 bp, Leuconostoc mesenteroides
  G6PDH
atggtttcagaaatcaaaacgttggtaactttctttggcggaactggtgatttagcaaagcgtaagctttacccatcagttttcaacctctacaaaaaaggatacttacaagaacactttgccattgttgggacagcacgtcaacaattaagtgatgacgagtttaagcaattggttcgtgattcaattaaagactttactgaagatcaagcacaagctgaagcgtttattgcgcatttttcttaccgtgcgcacgatgtcacagatgccgcttcttatggtatcttgaagtcagcgatcgaagaagcagcaaccaaatttgacattgatggcaatcgtattttctatatgtcagttgcccctcgtttcttcggtacaatcgctaaatatttgaaatcagaaggtttgctagctgagactggctacaatcgtttgatgattgaaaagccttttggtacatcatacgccaccgcagaagaattgcaaagtgatttggaaaatgcatttgatgatgaccaactgttccgtattgaccactatcttggaaaagaaatggtacaaaatattgcagcattacgttttggtaacccaatctttgatgccgcttggaataaggactatatcaaaaacgtacaagtaactttggctgaagttctaggtgttgaagagcgtgctggttactacgataccactggcgcccttttggatatgattcaaaaccacacaatgcaaattgttggttggttagcaatggaaaaacctgaatcattcaatgataaggatatccgtgcagctaaaaacgccgccttcaatgcattaaagatttataacgaagaagaagtgaataagtacttcgttcgtgcacaatatggtgctggtgatacagctgattacaagccatatttggaagaagcagatgtccctgctgactcaaagaacaacacattcattgctggtgaattgcagttcgatttgccacgttgggaaggtgttcctttctatgttcgttcaggtaagcgtttggctgccaagcaaacacgtgttgatattgtatttaaggctggcacattcaactttggttcagaacaagaagcacaagaatcagtactctcaatcatcattgatccaaagggtgctattgaattgaagcttaacgctaagtcagttgaagatgccttcaacacccgcacaatcaacttggattgggcagtatctgatgaagacaagaagaacacaccagaaccatacgaacgtatgattcacgatacaatgaatggtgacggatcaaactttgctgattggaacggtgtatcaattgcttggaagtttgttgacgcaattactgccgtttacgatgcagataaagcaccattggagacatataagtcaggttcaatgggtcctgaagcatcagacaagctattagctgaaaatggcgatgcttgggtatttaaaggataa

SEQ ID NO: 86 - DNA, 1047 bp, Saccharomyces cerevisiae
  ADH2
atgtctattccagaaactcaaaaagccattatcttctacgaatccaacggcaagttggagcataaggatatcccagttccaaagccaaagcccaacgaattgttaatcaacgtcaagtactctggtgtctgccacaccgatttgcacgcttggcatggtgactggccattgccaactaagttaccattagttggtggtcacgaaggtgccggtgtcgttgtcggcatgggtgaaaacgttaagggctggaagatcggtgactacgccggtatcaaatggttgaacggttcttgtatggcctgtgaatactgtgaattgggtaacgaatccaactgtcctcacgctgacttgtctggttacacccacgacggttctttccaagaatacgctaccgctgacgctgttcaagccgctcacattcctcaaggtactgacttggctgaagtcgcgccaatcttgtgtgctggtatcaccgtatacaaggctttgaagtctgccaacttgagagcaggccactgggcggccatttctggtgctgctggtggtctaggttctttggctgttcaatatgctaaggcgatgggttacagagtcttaggtattgatggtggtccaggaaaggaagaattgtttacctcgctcggtggtgaagtattcatcgacttcaccaaagagaaggacattgttagcgcagtcgttaaggctaccaacggcggtgcccacggtatcatcaatgtttccgtttccgaagccgctatcgaagcttctaccagatactgtagggcgaacggtactgttgtcttggttggtttgccagccggtgcaaagtgctcctctgatgtcttcaaccacgttgtcaagtctatctccattgtcggctcttacgtggggaacagagctgataccagagaagccttagatttctttgccagaggtctagtcaagtctccaataaaggtagttggcttatccagtttaccagaaatttacgaaaagatggagaagggccaaattgctggtagatacgttgttgacacttctaaataa

SEQ ID NO: 87 - DNA, 714 bp, Mesembryanthemum crystallinum
  McPFOMT
atggattttgctgtgatgaagcaggtcaaaaatacaggattgctacagagtgaggagttatgccagtatattctccgaactagtgtctatccgcgagaagcagggttcctcaaggaactcagggaagccaatgaaagtcacccagactcttatatgtcgacttcaccacttgctggacaattgatgtcattcgttctaaaattagtgaatgcaaagaagactattgaagttggagtctttacaggatactccctcttactcactgctctttcaattcctgatgatggaaagattacggcaattgatttcgacagagaggcatatgagattggcttgccatttatcagaaaagctggtgtggagcacaaaatcaacttcattgaatcggatgctatgctagctcttgacaatcttctgcaaggacaagagagcgaggggagttacgactttggctttgttgatgcggacaaacctaactacatcaagtaccatgagaggttgatgaaactagtcaaggtgggtggcatagtcgcttatgacaacacattatggggtggaactgtagcccagcctgaatccgaagtaccagatttcatgaaggaaaacagagaagctgttattgaactcaacaagttgcttgctgctgatcctcgtatcgagattgtacatcttcctttgggtgatggtatcactttctgcaggcgtctttattga

SEQ ID NO: 88 - DNA, 1092 bp, Arabidopsis thaliana
  (AtCOMT)
atgggttcaacggcagagacacaattaactccggtgcaagtcaccgacgacgaagctgccctcttcgccatgcaactagccagtgcttccgttcttccgatggctttaaaatccgccttagagcttgaccttcttgagattatggccaagaatggttctcccatgtctcctaccgagatcgcttctaaacttccgaccaaaaatcctgaagctccggtcatgctcgaccgtatcctccgtcttcttacgtcttactccgtcttaacctgctccaaccgtaaactttccggtgatggcgttgaacggatttacgggcttggtccggtttgcaagtatttgaccaagaacgaagatggtgtttccattgctgctctttgtcttatgaaccaagacaaggttctcatggaaagctggtaccatttgaaggatgcaattcttgatggtgggattccattcaacaaggcttatggaatgagcgcgttcgagtaccacgggactgaccctagattcaacaaggtctttaacaatggaatgtctaaccattccacaatcaccatgaagaagattcttgagacctataagggttttgaaggattgacttctttggttgatgttggtggtggcattggtgctacactcaaaatgattgtctccaagtaccctaatcttaaaggcatcaactttgatctcccacatgtcatcgaagatgctccttctcatcctggtattgagcatgttggaggagatatgtttgtaagtgtccctaaaggtgatgccatattcatgaagtggatatgtcatgactggagtgacgaacattgcgtgaaattcttgaagaactgctacgagtcacttccagaggatggaaaagtgatattagcagagtgtatacttccagagacaccagactcaagcctctcaaccaaacaagtagtccatgtcgattgcattatgttggctcacaatcccggaggcaaagaacgaaccgagaaagagtttgaggcattagccaaagcatcaggcttcaagggcatcaaagttgtctgcgacgcttttggtgttaaccttattgagttactcaagaagctctaa

SEQ ID NO: 89 - DNA, 1107 bp, Clarkia breweri
  IEMT1
atgggtagcactgggaacgcagaaatccagattattcccacccattcgtcggacgaagaagcgaacttatttgcgatgcagttagcctcggctgctgtgctgcctatggccctgaaagctgcgattgaacttgacgtactcgaaattatggccaaaagcgtaccaccgtctggttacatttcaccagcagaaattgctgcgcaattgccgacgacgaatcccgaagcaccagtgatgttggatcgcgtgttgcgtctgctggccagttattcagtggtgacctatacccttcgggaactgccgtctggcaaagtggagcgtctgtatgggttagcccctgtctgcaagtttctgacgaagaatgaggatggagtttccctggctccgtttctccttaccgccacagacaaagtgttgctggaaccgtggttttacctgaaagatgccattctggaaggtgggattccgttcaacaaagcgtatggcatgaatgagttcgattaccatggcactgatcaccgcttcaacaaagtgttcaacaaaggcatgtcgagcaattccaccatcacaatgaagaaaatcctcgaaatgtacaacgggtttgaaggcctgacgaccattgttgacgtaggcggaggcacaggtgcagttgcgtccatgattgtcgcgaaatacccgagcatcaatgcgatcaactttgatctgccgcatgtcatccaggatgcaccggcatttagcggtgtcgaacacttaggtggagacatgttcgatggcgttcccaaaggtgatgcgatcttcatcaaatggatttgtcacgactggtctgatgagcactgcttaaaactgctcaagaattgctatgccgcacttcctgatcatggcaaagtcattgttgcggagtatatcctgccaccgagtcctgatccgagcattgctacgaaagtagtgatccatactgacgcgctgatgctggcctataatccgggtggtaaagagcgtaccgaaaaggaatttcaagcgctggcgatggcgtcaggctttcgcggctttaaagttgcaagttgtgccttcaacacctacgttatggagttcctgaaaaccgcctaa

SEQ ID NO: 90 - DNA, 1155 bp, Saccharomyces cereviasiae
  ScSAMS
atgtccaagagcaaaactttcttatttacctctgaatccgtcggtgaaggtcacccagacaagatttgtgaccaagtttctgatgctattttggacgcttgtttagaacaagatccattctccaaggttgcctgtgaaacagctgccaaaactggtatgattatggttttcggtgaaattaccaccaaagctagacttgactaccaacaaatagtaagagataccatcaagaagattggttatgacgattctgccaagggtttcgactacaagacatgtaatgttttagtagctatcgaacaacaatctccagatatcgctcaaggtctgcactatgaaaagagcttagaagacttaggtgctggtgaccaaggtataatgtttggttacgctacagacgaaactccagaagggttaccattgaccattcttttggctcacaaattgaacatggctatggcagatgctagaagagatggttctctcccatggttgagaccagacacaaagactcaagtcactgtcgaatacgaagacgacaatggtagatgggttccaaagaggatagataccgttgttatttctgctcaacatgctgatgaaatttccaccgctgacttgagaactcaacttcaaaaagatattgttgaaaaggtcataccaaaggatatgttagacgaaaataccaaatatttcatccaaccatccggtagattcgtcatcggtggtcctcaaggtgacgctggtttgaccggtagaaagattattgtcgacgcttacggtggtgcctcatccgtcggtggtggtgccttctccggtaaggactattccaaggtcgatcgttccgctgcttacgctgctagatgggttgccaagtctctagttgccgctggtttgtgtaagagagtccaagtccaattttcatatgctattggtattgctgaaccattgtctttacatgtggacacctatggtacagctacaaaatcagatgacgaaatcattgaaattattaagaagaacttcgacttgagaccaggtgtgttagtaaaggaattagatttggctagaccaatttacttaccaaccgcttcttatggtcacttcactaatcaagagtactcatgggaaaaaccaaagaaattggaattttaa

SEQ ID NO: 91 - DNA, 1221 bp, Cryptosporidium parvum
  CpSAMS
atggattcttcgaggtttagtggaaataaatccacttacactgacttacagactacttctgaacaatttttattttcttcagagtctgtttgtagtggccacccagataaattatgtgatcagatttcggatgcaatccttgatgcgtgcttggaacaagatccagaaagctttgtagcatgtgaaacatgcacaaaaacagggttcattatggtttttggtgaaataactacaaaggctaatgtaaattacgaaagagttgtaagagaaacagtgaaagaaataggatatgactctgaagaaaaagggttagattacaaaactatggatgtgattattaagctagaacaacaaagtaatcaaattgctgggtgtgtacatgtagataaaaatgtagaagatattggagcgggtgaccaaggaatgatgtttggttatgctacgaatgaaacaaaagaactcatgcctctgacgcacgtattagctacatctattacaagagagctggattatatcagagtgaaaggagtatcttctcgggtgggttggctgcgccctgatggaaaggcgcaagtgacagtagaatataactgcaaacatggcgtgctcattccaaaaagaattcacactattttagtttcggttcagcatgatgaaaacatagaaaacgaggaaattagagaatttgtactggagaatgtaattaaaaaagtatgcccttcagatttgatggacaaagaaactagaatattaattaatccatctggcaggtttacaattggtgggccagcagcagatgctggattaacagggcgcaagataattgtagatacatacggaggatggggtgctcatgggggtggtgcatttagcgggaaagatgcaactaaagtagatagatcaggtgcatatatggcaaggcttgttgcaaagtcaatcgtcttttccggcttgtgtagcagatgtttggtacaggtttcgtatggaattggaatagcaaggcctttgtcactgtatattaatacatttggcacagcgaaagatgggtataatgacgcaaaactactggagatagttaataaggtatttgattttaggccaggaattctaattaagcagctaaaccttaaatctcctatttttaaaaagacatcaagtggcggacattttggacgatcagaagaagagtttctttgggaaaagccaattattttacaatag

SEQ ID NO: 92 - DNA, 1179 bp, Leishmania donovani
  LdSAMS
atgtctgtccacagcattctcttctcctccgagcacgtgacggagggccatccagacaagctgtgcgatcaggtatccgacgctgtgcttgacgcgtgcctcgccggcgacccgttctcgaaggttgcgtgcgagtcgtgcgcgaagacgggcatggtgatggtgttcggcgagatcacgacaaaggcagtgctagactaccagaagatcgtccgcaacacgatcaaggacattggcttcgattccgcggacaagggtctggactacgagtcgtgcaatgtgctggttgcgattgagcagcagtcgccggacatctgccagggtctgggcaacttcgatagcgaggatctcggcgctggcgaccagggcatgatgttcggctacgcgacggacgagacggagacgctgatgccgctgacgtacgagctggcccgcggccttgcgaagaagtacagcgagcttcgccgctccggcagcctggagtgggctcgcccggacgcgaagacgcaggtgacggtggagtacgactacgacacgcgcgagggcaagcaggtgctgacgccgaagcgcgtggcggtggtgctgatctctgcgcagcacgacgagcacgtgaccaacgataagatcagcgtggatctgatggagaaggtgatcaaggctgtgatccctgcgaacatgctggacgcggagacgaagtactggctgaacccatctggccgcttcgtgcgcggtgggccgcatggcgacgccggtctgactggccgaaagatcatcgtagacacgtacggcggctggggcgcgcacggcggtggcgccttctccggtaaggacccttcgaaggtggaccgctccgccgcgtacgccgcgcgatggatcgcgaagtcgatcgttgcaggtggcctggcgcgccgctgccttgtgcagctcgcgtacgccatcggtgtagcggagccgctgagcatgcacgtggagacgtacggcaccggcaagtacgatgacgcgaagctgctggagatcgtgaagcagaacttcaagctgcgcccgtacgacatcatccaggagctgaacctgcgccgccccatctactacgatacgtcgcgcttcggccacttcggccgtaaggacgagttgggcacgggcgggttcacttgggaggtgccaaagaagatggtcgagtaa

SEQ ID NO: 93 - DNA, 1200 bp, Mycobacterium smegmatis
  MsSAMS
gtgagcaaaggtcgcctgtttaccagtgagtcggtaaccgaagggcaccccgacaagatctgtgacgcaatcagcgactctgtgctcgacgcgctgctggagcaggatcccaagtcccgcgtcgccgtcgagacgctggtcaccacgggccaggtgcacgtcgccggtgaggtgaccaccacggcgtacgccgacatccccaagatcgtgcgcgaccgcatcctcgacatcggctacgactcgtcgaccaagggcttcgacggcgcctcgtgcggcgtcaacgtggcgatcggtgcgcagtcgcccgacatcgcccaaggcgtcgacaccgcccacgagacccgcgtcgagggcaaggccgacccgctggacctgcagggcgcaggcgaccagggcctgatgttcggctacgccatcggcgacacccccgaactcatgccgctgcccatcgcgctggcccaccgcctcgcgcgccgcctgaccgaggtgcgcaagaacggtgtgctggactacctgcggcccgacggcaagacccaggtcaccatccagtacgacggcaccaccccggtgcggttggacaccgtggtgctgtccacccagcacgccgacggcatcgacctggagggcaccctcacgcccgacatccgcgagaaggtcgtcaacaccgtgctcgccgatctcggccatgagaccctcgacacgtccgactaccgcctgctggtcaacccgacgggcaagttcgtcctcggcggccccatgggcgacgccggcctgaccggccgcaagatcatcgtcgacacctacggcggctgggctcgccacggcggcggcgccttctcgggcaaggatccgtcaaaggtcgaccgctcggccgcctacgcgatgcgctgggtcgccaagaacgtcgtcgccgctggcctggccgagcgcgtcgaggtgcaggtcgcctacgcgatcggcaaggccgccccggtgggtctgttcgtggagaccttcggcagcgagaccgtcgacccggccaagatcgagaaggccatcggcgaggtgttcgacctgcgtcccgccgcgatcgtgcgcgacctcgacctgctgcgcccgatctacgcgcccaccgccgcgtacggacacttcggccgcaccgacatcgagctgccgtgggagcagaccaacaaggtggacgacctgaagtccgccatctga

SEQ ID NO: 94 - DNA, 3398 bp, Bos taurus
  BtSAMS cDNA
gaccagtcagagggagtgacacatcgctctccagtccctcctcctcgcccgtccgcacctttactcacgtgctggcggacacttaggcagaagtgagccccgtggctctgccaaagacgagcctgttggctttaaaggaggaaaattaaaaaaaccttaggccaggtcccagcattaaaattgttaccttgaagacgctgagtggagaagtgtgaagagatgaatggaccagtggatggcttgtgtgatcattctctaagtgaggaaggagcattcatgttcacatcggaatctgtaggagaggggcacccggataagatctgtgaccagatcagtgatgcagtgctggatgcccatctcaagcaggaccccaatgccaaggtggcctgtgagacggtgtgtaagacgggcatggtgcttctgtgcggggagatcacctccatggccatggtggattaccagcgtgtggtgcgggagaccatccagcacatcggctacgacgactccgccaagggctttgactttaagacctgcaacgtgctggtggctttggagcagcagtccccggatatcgcccagtgtgtccacctggacagaaatgaagaggatgtcggtgccggagatcaggggctgatgtttggctatgccacggatgagacggaagagtgcatgcccctcaccatcatgctggcgcacagactcaacgcccgcatggcagagctgcgacgctcagggcagctcccctggctgcaacctgactccaagacacaggtgacagtgcagtacacgcaggacaacggtgcggtcatccctatgcgcgtccataccgtcgtcatctccgtgcagcacaacgaagacataacgctggaggacatgcgcagagccctgaaggagcaggtgatcagggctgttgtgccagcacggtacctggacgaggacaccatctaccacctgcagcccagtgggcgctttgtcatcggaggcccccagggggatgccggtgtcactggccgaaagatcatcgtggacacctatggcggctggggggcacacggcggaggcgccttctctgggaaggactacaccaaggtggaccgctcggcagcgtacgctgcccgctgggtggccaagtccctggtgaaagcagggctctgccggagggtgcttgtgcaggtgtcctatgccattggtgtggctgagccactgtctatttccatctttacctatggaacctcccagaagacagagagagagctgctggatgtggtcaataagaactttgaccttcggcctggtgttatcgtcagggacttggacttgaagaagcccatctaccagaagacagcatgctacggccacttcgggaggagcgagttcccttgggaagttcccaaaaagcttgtgttttagtgctggtgggggccactccagctggtgagccctggaggcttcaggtgggacagagccatgctcttctcctccaggaccctgactctcagatcacccactgcccccttcctgggcagagccaggcccctctgacttagcaggaggaagggggccttctggtgccagggctcagatctcctcatgaggccagtcactatgtttccctgcctctcccccagaccaaggtgatgtgaatttagtggaaatagcatccctgtcagaggaaacctgctcactcccctgcccccacagcctggaccctgagtggcccctccttccctggtgtgtgctgggaagatcttagggctccatgagggtctgggtgtgccgggccacccttcacgtctgcagccatttggtcgccgtcctgagcctgagccttcccatgggccctcccaggccatgcttgtggcagggatgacagcagctagcgtgtgagagaccaagctcatcactgatctcatttcttcttcactgcaatacgatgaggtgacaccttgtgttacaagcatttaaggtgaggaggccgagctaactttcacagggcccacagctgcatgggtcagggcctagacatgcgtctggtatctttgaattgtgagcccatacactttgacccctcaccctcagcaccgccccccaccccgatctcatgctagaaacaggtctgagtgaagagatgaggctgtgacctctgtcctgaagacctgacgttgctgggagttaggggatcgagtcccttggcgacccctgaacagtgatctacagagccaagtcagaaccaaagggatgtttcctttgcctctgtaatttcagaagatagattagggtgtgctggatatcctggcccctggggctgcgctggagtttgaaattaagaggcacctatgttatcccagcccctgactactcagggacatgcagggttgggcccatggactcctccgatgagggtccaaggccagtcctgtcccgtatagggcttcctagagcagaagcagcagcttgtcccttaaacaagggatagaatcctgtgtcctccacatgcttctctctctctgacccctttctctctctcttgtaacccctgcaatctgagtgctgttggaataagtgggtgagcctctcagatcccccttccagagaggacagcccaaaggcctgaattcaaatgttaaatggtgactgaagtggcaagtcttgactcctagagggagctaagttggctgagatgtcatgaggagatttctgcctttgccaggtggcctctggggccagggctacccctgaggtcttgggtgattcttggcacattaaggtcttagaagctatgcattctcttgctttcctttccatggccagtacctccctgtactccttccccaacctgggcctctgactgctgcactgctaccttatccccagctccgcagaccacaggttcaggtaggagcccccacaggtccccggagaatactggggtctggcttcttcctgtggcactcggtgccagctccagctgagatgcacagctcaggaagcctcatttgggcagcagacagcctgcactgaactgtaggcctgaagcacaaaaacctttggctttctctttccatcaggggaaaggcagcagttcagggcagaaaaagaagcccagatgaccataaacacctaaagctgatgtgtgatatggaagctcaggagtctcatagggctctggtcacttgggaagtctcaagttccttttcctttaggtttgcaggtggctgagttcctctaacttgggccatatttgaagtgaaaatgcaaatttttatactttctgcaccccctgggagaaacaaggttttcttgggtcaacactgttatatgaaactcgagtctttatttcttaatagtgcctgctaagccagtgaataaaaactcgagaagcaaaaaaaaaaaaaaaa

SEQ ID NO: 95 - DNA, 3150 bp, Bacillus megaterium
  A75G F88V L189Q R472C
atgacaattaaagaaatgcctcagccaaaaacgtttggagagcttaaaaatttaccgttattaaacacagataaaccggttcaagctttgatgaaaattgcggatgaattaggagaaatctttaaattcgaggcgcctggtcgtgtaacgcgctacttatcaagtcagcgtctaattaaagaagcatgcgatgaatcacgctttgataaaaacttaagtcaaggtcttaaatttgtacgtgattttgcaggagacgggttggttacaagctggacgcatgaaaaaaattggaaaaaagcgcataatatcttacttccaagcttcagtcagcaggcaatgaaaggctatcatgcgatgatggtcgatatcgccgtgcagcttgttcaaaagtgggagcgtctaaatgcagatgagcatattgaagtaccggaagacatgacacgtttaacgcttgatacaattggtctttgcggctttaactatcgctttaacagcttttaccgagatcagcctcatccatttattacaagtatggtccgtgcactggatgaagcaatgaacaagcagcagcgagcaaatccagacgacccagcttatgatgaaaacaagcgccagtttcaagaagatatcaaggtgatgaacgacctagtagataaaattattgcagatcgcaaagcaagcggtgaacaaagcgatgatttattaacgcatatgctaaacggaaaagatccagaaacgggtgagccgcttgatgacgagaacattcgctatcaaattattacattcttaattgcgggacacgaaacaacaagtggtcttttatcatttgcgctgtatttcttagtgaaaaatccacatgtattacaaaaagcagcagaagaagcagcacgagttctagtagatcctgttccaagctacaaacaagtcaaacagcttaaatatgtcggcatggtcttaaacgaagcgctgcgcttatggccaactgctcctgcgttttccctatatgcaaaagaagatacggtgcttggaggagaatatcctttagaaaaaggcgacgaactaatggttctgattcctcagcttcaccgtgataaaacaatttggggagacgatgtggaagagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctggatattaaagaaactttaacgttaaaacctgaaggctttgtggtaaaagcaaaatcgaaaaaaattccgcttggcggtattccttcacctagcactgaacagtctgctaaaaaagtatgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctgggtaa

SEQ ID NO: 96 - DNA, 3150 bp, Bacillus megaterium
  A75G/ F88V/L189Q/A331S/R472C
atgacaattaaagaaatgcctcagccaaaaacgtttggagagcttaaaaatttaccgttattaaacacagataaaccggttcaagctttgatgaaaattgcggatgaattaggagaaatctttaaattcgaggcgcctggtcgtgtaacgcgctacttatcaagtcagcgtctaattaaagaagcatgcgatgaatcacgctttgataaaaacttaagtcaaggtcttaaatttgtacgtgattttgcaggagacgggttggttacaagctggacgcatgaaaaaaattggaaaaaagcgcataatatcttacttccaagcttcagtcagcaggcaatgaaaggctatcatgcgatgatggtcgatatcgccgtgcagcttgttcaaaagtgggagcgtctaaatgcagatgagcatattgaagtaccggaagacatgacacgtttaacgcttgatacaattggtctttgcggctttaactatcgctttaacagcttttaccgagatcagcctcatccatttattacaagtatggtccgtgcactggatgaagcaatgaacaagcagcagcgagcaaatccagacgacccagcttatgatgaaaacaagcgccagtttcaagaagatatcaaggtgatgaacgacctagtagataaaattattgcagatcgcaaagcaagcggtgaacaaagcgatgatttattaacgcatatgctaaacggaaaagatccagaaacgggtgagccgcttgatgacgagaacattcgctatcaaattattacattcttaattgcgggacacgaaacaacaagtggtcttttatcatttgcgctgtatttcttagtgaaaaatccacatgtattacaaaaagcagcagaagaagcagcacgagttctagtagatcctgttccaagctacaaacaagtcaaacagcttaaatatgtcggcatggtcttaaacgaagcgctgcgcttatggccaactgctccttcgttttccctatatgcaaaagaagatacggtgcttggaggagaatatcctttagaaaaaggcgacgaactaatggttctgattcctcagcttcaccgtgataaaacaatttggggagacgatgtggaagagttccgtccagagcgttttgaaaatccaagtgcgattccgcagcatgcgtttaaaccgtttggaaacggtcagcgtgcgtgtatcggtcagcagttcgctcttcatgaagcaacgctggtacttggtatgatgctaaaacactttgactttgaagatcatacaaactacgagctggatattaaagaaactttaacgttaaaacctgaaggctttgtggtaaaagcaaaatcgaaaaaaattccgcttggcggtattccttcacctagcactgaacagtctgctaaaaaagtatgcaaaaaggcagaaaacgctcataatacgccgctgcttgtgctatacggttcaaatatgggaacagctgaaggaacggcgcgtgatttagcagatattgcaatgagcaaaggatttgcaccgcaggtcgcaacgcttgattcacacgccggaaatcttccgcgcgaaggagctgtattaattgtaacggcgtcttataacggtcatccgcctgataacgcaaagcaatttgtcgactggttagaccaagcgtctgctgatgaagtaaaaggcgttcgctactccgtatttggatgcggcgataaaaactgggctactacgtatcaaaaagtgcctgcttttatcgatgaaacgcttgccgctaaaggggcagaaaacatcgctgaccgcggtgaagcagatgcaagcgacgactttgaaggcacatatgaagaatggcgtgaacatatgtggagtgacgtagcagcctactttaacctcgacattgaaaacagtgaagataataaatctactctttcacttcaatttgtcgacagcgccgcggatatgccgcttgcgaaaatgcacggtgcgttttcaacgaacgtcgtagcaagcaaagaacttcaacagccaggcagtgcacgaagcacgcgacatcttgaaattgaacttccaaaagaagcttcttatcaagaaggagatcatttaggtgttattcctcgcaactatgaaggaatagtaaaccgtgtaacagcaaggttcggcctagatgcatcacagcaaatccgtctggaagcagaagaagaaaaattagctcatttgccactcgctaaaacagtatccgtagaagagcttctgcaatacgtggagcttcaagatcctgttacgcgcacgcagcttcgcgcaatggctgctaaaacggtctgcccgccgcataaagtagagcttgaagccttgcttgaaaagcaagcctacaaagaacaagtgctggcaaaacgtttaacaatgcttgaactgcttgaaaaatacccggcgtgtgaaatgaaattcagcgaatttatcgcccttctgccaagcatacgcccgcgctattactcgatttcttcatcacctcgtgtcgatgaaaaacaagcaagcatcacggtcagcgttgtctcaggagaagcgtggagcggatatggagaatataaaggaattgcgtcgaactatcttgccgagctgcaagaaggagatacgattacgtgctttatttccacaccgcagtcagaatttacgctgccaaaagaccctgaaacgccgcttatcatggtcggaccgggaacaggcgtcgcgccgtttagaggctttgtgcaggcgcgcaaacagctaaaagaacaaggacagtcacttggagaagcacatttatacttcggctgccgttcacctcatgaagactatctgtatcaagaagagcttgaaaacgcccaaagcgaaggcatcattacgcttcataccgctttttctcgcatgccaaatcagccgaaaacatacgttcagcacgtaatggaacaagacggcaagaaattgattgaacttcttgatcaaggagcgcacttctatatttgcggagacggaagccaaatggcacctgccgttgaagcaacgcttatgaaaagctatgctgacgttcaccaagtgagtgaagcagacgctcgcttatggctgcagcagctagaagaaaaaggccgatacgcaaaagacgtgtgggctgggtaa

SEQ ID NO: 97 - protein, 1049 aa, Bacillus megaterium [sequence omitted]

SEQ ID NO: 98 - protein, 520 aa, Escherichia coli
  4HPA3H HpaB wt
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 99 - protein, 520 aa, Escherichia coli
  4HPA3H HpaB I157A
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAAVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 100 - protein, 520 aa, Escherichia coli
  4HPA3H HpaB I157C
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHACVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 101 - protein, 520 aa, Escherichia coli
  4HPA3H HpaB I157D
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHADVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 102 - protein, 520 aa, Escherichia coli
  4HPA3H HpaB I157E
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAEVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 103 - protein, 520 aa, Escherichia coli
  4HPA3H HpaB I157F
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAFVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 104 - protein, 520 aa, Escherichia coli
  4HPA3H HpaB I157G
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAGVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 105 - protein, 520 aa, Escherichia coli
  4HPA3H HpaB I157H
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAHVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 106 - protein, 520 aa, Escherichia coli
  4HPA3H HpaB I157K
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAKVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 107 - protein, 520 aa, Escherichia coli
  4HPA3H HpaB I157L
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHALVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 108 - protein, 520 aa, Escherichia coli
  4HPA3H HpaB I157M
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAMVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 109 - protein, 520 aa, Escherichia coli
  4HPA3H HpaB I157N
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHANVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 110 - protein, 520 aa, Escherichia coli
  4HPA3H HpaB I157P
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAPVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 111 - protein, 520 aa, Escherichia coli
  4HPA3H HpaB I157Q
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAQVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 112 - protein, 520 aa, Escherichia coli
  4HPA3H HpaB I157R
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHARVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 113 - protein, 520 aa, Escherichia coli
  4HPA3H HpaB I157S
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHASVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 114 - protein, 520 aa, Escherichia coli
  4HPA3H HpaB I157T
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHATVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 115 - protein, 520 aa, Escherichia coli
  4HPA3H HpaB I157V
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAVVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 116 - protein, 520 aa, Escherichia coli
  4HPA3H HpaB I157W
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAWVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 117 - protein, 520 aa, Escherichia coli
  4HPA3H HpaB I157Y
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAYVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 118 - protein, 520 aa, Escherichia coli
  4HPA3H HpaB M293A
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTAEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 119 - protein, 520 aa, Escherichia coli
  4HPA3H HpaB M293C
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTCEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 120 - protein, 520 aa, Escherichia coli
  4HPA3H HpaB M293D
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTDEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 121 - protein, 520 aa, Escherichia coli
  4HPA3H HpaB M293E
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTEEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 122 - protein, 520 aa, Escherichia coli
  4HPA3H HpaB M293F
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTFEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 123 - protein, 520 aa, Escherichia coli
  4HPA3H HpaB M293G
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTGEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 124 - protein, 520 aa, Escherichia coli
  4HPA3H HpaB M293H
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTHEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 125 - protein, 520 aa, Escherichia coli
  4HPA3H HpaB M293I
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTIEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 126 - protein, 520 aa, Escherichia coli
  4HPA3H HpaB M293K
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTKEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 127 - protein, 520 aa, Escherichia coli
  4HPA3H HpaB M293L
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTLEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 128 - protein, 520 aa, Escherichia coli
  4HPA3H HpaB M293N
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTNEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 129 - protein, 520 aa, Escherichia coli
  4HPA3H HpaB M293P
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTPEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 130 - protein, 520 aa, Escherichia coli
  4HPA3H HpaB M293Q
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTQEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 131 - protein, 520 aa, Escherichia coli
  4HPA3H HpaB M293R
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTREGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 132 - protein, 520 aa, Escherichia coli
  4HPA3H HpaB M293S
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTSEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 133 - protein, 520 aa, Escherichia coli
  4HPA3H HpaB M293T
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTTEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 134 - protein, 520 aa, Escherichia coli
  4HPA3H HpaB M293V
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTVEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 135 - protein, 520 aa, Escherichia coli
  4HPA3H HpaB M293W
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTWEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 136 - protein, 520 aa, Escherichia coli
  4HPA3H HpaB M293Y
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTYEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 137 - protein, 520 aa, Escherichia coli
  4HPA3H HpaB Y301A
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMAPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 138 - protein, 520 aa, Escherichia coli
  4HPA3H HpaB Y301C
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMCPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 139 - protein, 520 aa, Escherichia coli
  4HPA3H HpaB Y301D
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMDPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 140 - protein, 520 aa, Escherichia coli
  4HPA3H HpaB Y301E
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMEPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 141 - protein, 520 aa, Escherichia coli
  4HPA3H HpaB Y301F
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMFPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 142 - protein, 520 aa, Escherichia coli
  4HPA3H HpaB Y301G
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMGPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 143 - protein, 520 aa, Escherichia coli
  4HPA3H HpaB Y301H
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMHPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 144 - protein, 520 aa, Escherichia coli
  4HPA3H HpaB Y301I
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMIPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 145 - protein, 520 aa, Escherichia coli
  4HPA3H HpaB Y301K
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMKPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 146 - protein, 520 aa, Escherichia coli
  4HPA3H HpaB Y301L
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMLPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 147 - protein, 520 aa, Escherichia coli
  4HPA3H HpaB Y301M
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMMPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 148 - protein, 520 aa, Escherichia coli
  4HPA3H HpaB Y301N
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMNPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 149 - protein, 520 aa, Escherichia coli
  4HPA3H HpaB Y301P
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMPPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 150 - protein, 520 aa, Escherichia coli
  4HPA3H HpaB Y301Q
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMQPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 151 - protein, 520 aa, Escherichia coli
  4HPA3H HpaB Y301R
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMRPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 152 - protein, 520 aa, Escherichia coli
  4HPA3H HpaB Y301S
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMSPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 153 - protein, 520 aa, Escherichia coli
  4HPA3H HpaB Y301T
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMTPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 154 - protein, 520 aa, Escherichia coli
  4HPA3H HpaB Y301V
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMVPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 155 - protein, 520 aa, Escherichia coli
  4HPA3H HpaB Y301W
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMWPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYSGSQDEIRLQCLRQAQNSGNMDKMMAMVDRCLSEYDQDGWTVPHLHNNDDINMLDKLLK

SEQ ID NO: 156 - protein, 520 aa, Escherichia coli
  4HPA3H HpaB S462A
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYAGSQDEIRLQCLRQAQNSGNMDKMMAMVDRCLSEYDQDGWTVPHLHNNDDINMLDKLLK

SEQ ID NO: 157 - protein, 520 aa, Escherichia coli
  4HPA3H HpaB S462C
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYCGSQDEIRLQCLRQAQNSGNMDKMMAMVDRCLSEYDQDGWTVPHLHNNDDINMLDKLLK

SEQ ID NO: 158 - protein, 520 aa, Escherichia coli
  4HPA3H HpaB S462D
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYDGSQDEIRLQCLRQAQNSGNMDKMMAMVDRCLSEYDQDGWTVPHLHNNDDINMLDKLLK

SEQ ID NO: 159 - protein, 520 aa, Escherichia coli
  4HPA3H HpaB S462E
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYEGSQDEIRLQCLRQAQNSGNMDKMMAMVDRCLSEYDQDGWTVPHLHNNDDINMLDKLLK

SEQ ID NO: 160 - protein, 520 aa, Escherichia coli
  4HPA3H HpaB S462F
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYFGSQDEIRLQCLRQAQNSGNMDKMMAMVDRCLSEYDQDGWTVPHLHNNDDINMLDKLLK

SEQ ID NO: 161 - protein, 520 aa, Escherichia coli
  4HPA3H HpaB S462G
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYGGSQDEIRLQCLRQAQNSGNMDKMMAMVDRCLSEYDQDGWTVPHLHNNDDINMLDKLLK

SEQ ID NO: 162 - protein, 520 aa, Escherichia coli
  4HPA3H HpaB S462H
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYHGSQDEIRLQCLRQAQNSGNMDKMMAMVDRCLSEYDQDGWTVPHLHNNDDINMLDKLLK

SEQ ID NO: 163 - protein, 520 aa, Escherichia coli
  4HPA3H HpaB S462I
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYIGSQDEIRLQCLRQAQNSGNMDKMMAMVDRCLSEYDQDGWTVPHLHNNDDINMLDKLLK

SEQ ID NO: 164 - protein, 520 aa, Escherichia coli
  4HPA3H HpaB S462K
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYKGSQDEIRLQCLRQAQNSGNMDKMMAMVDRCLSEYDQDGWTVPHLHNNDDINMLDKLLK

SEQ ID NO: 165 - protein, 520 aa, Escherichia coli
  4HPA3H HpaB S462L
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYLGSQDEIRLQCLRQAQNSGNMDKMMAMVDRCLSEYDQDGWTVPHLHNNDDINMLDKLLK

SEQ ID NO: 166 - protein, 520 aa, Escherichia coli
  4HPA3H HpaB S462M
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYMGSQDEIRLQCLRQAQNSGNMDKMMAMVDRCLSEYDQDGWTVPHLHNNDDINMLDKLLK

SEQ ID NO: 167 - protein, 520 aa, Escherichia coli
  4HPA3H HpaB S462N
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYNGSQDEIRLQCLRQAQNSGNMDKMMAMVDRCLSEYDQDGWTVPHLHNNDDINMLDKLLK

SEQ ID NO: 168 - protein, 520 aa, Escherichia coli
  4HPA3H HpaB S462P
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYPGSQDEIRLQCLRQAQNSGNMDKMMAMVDRCLSEYDQDGWTVPHLHNNDDINMLDKLLK

SEQ ID NO: 169 - protein, 520 aa, Escherichia coli
  4HPA3H HpaB S462Q
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYQGSQDEIRLQCLRQAQNSGNMDKMMAMVDRCLSEYDQDGWTVPHLHNNDDINMLDKLLK

SEQ ID NO: 170 - protein, 520 aa, Escherichia coli
  4HPA3H HpaB S462R
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYRGSQDEIRLQCLRQAQNSGNMDKMMAMVDRCLSEYDQDGWTVPHLHNNDDINMLDKLLK

SEQ ID NO: 171 - protein, 520 aa, Escherichia coli
  4HPA3H HpaB S462T
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYTGSQDEIRLQCLRQAQNSGNMDKMMAMVDRCLSEYDQDGWTVPHLHNNDDINMLDKLLK

SEQ ID NO: 172 - protein, 520 aa, Escherichia coli
  4HPA3H HpaB S462V
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYVGSQDEIRLQCLRQAQNSGNMDKMMAMVDRCLSEYDQDGWTVPHLHNNDDINMLDKLLK

SEQ ID NO: 173 - protein, 520 aa, Escherichia coli
  4HPA3H HpaB S462W
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYWGSQDEIRLQCLRQAQNSGNMDKMMAMVDRCLSEYDQDGWTVPHLHNNDDINMLDKLLK

SEQ ID NO: 174 - protein, 520 aa, Escherichia coli
  4HPA3H HpaB S462Y
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMYPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYYGSQDEIRLQCLRQAQNSGNMDKMMAMVDRCLSEYDQDGWTVPHLHNNDDINMLDKLLK

SEQ ID NO: 175 - protein, 520 aa, Escherichia coli
  4HPA3H HpaB Y301F/S462A
MKPEDFRASTQRPFTGEEYLKSLQDGREIYIYGERVKDVTTHPAFRNAAASVAQLYDALHKPEMQDSLCWNTDTGSGGYTHKFFRVAKSADDLRQQRDAIAEWSRLSYGWMGRTPDYKAAFGCALGANPGFYGQFEQNARNWYTRIQETGLYFNHAIVNPPIDRHLPTDKVKDVYIKLEKETDAGIIVSGAKVVATNSALTHYNMIGFGSAQVMGENPDFALMFVAPMDADGVKLISRASYEMVAGATGSPYDYPLSSRFDENDAILVMDNVLIPWENVLIYRDFDRCRRWTMEGGFARMFPLQACVRLAVKLDFITALLKKSLECTGTLEFRGVQADLGEVVAWRNTFWALSDSMCSEATPWVNGAYLPDHAALQTYRVLAPMAYAKIKNIIERNVTSGLIYLPSSARDLNNPQIDQYLAKYVRGSNGMDHVQRIKILKLMWDAIGSEFGGRHELYEINYAGSQDEIRLQCLRQAQNSGNMDKMMAMVDRCLSEYDQDGWTVPHLHNNDDINMLDKLLK

SEQ ID NO: 176 - protein, 186 aa, Pseudomonas protegens
  flavin reductase PrnF
MNAATETKVHDLLDAEGRDVRDARELRNVLGQFATGVTVITTRTADGRNVGVTANSFSSLSLSPALVLWSLARTAPSLKAFCSASHFAINVLGAHQHHLSEQFARAAADKFAGVAHSYGKAGAPVLDDVVAVLVCRNVTQYEGGDHLIFIGEIEQYRYSGAEPLVFHAGQYRGLGSNRAESVLKHE

SEQ ID NO: 177 - protein, 376 aa, Candida boidinii
  formate dehydrogenase FDH
MSKGKVLLVLYEGGKHAEEQEKLLGCIENELGIRNFIEEQGYELVTTIDKDPEPTSTVDRELKDAEIVITTPFFPAYISRNRIAEAPNLKLCVTAGVGSDHVDLEAANERKITVTEVTGSNVVSVAEHVMATILVLIRNYNGGHQQAINGEWDIAGVAKNEYDLEDKIISTVGAGRIGYRVLERLVAFNPKKLLYYDYQELPAEAINRLNEASKLFNGRGDIVQRVEKLEDMVAQSDVVTINCPLHKDSRGLFNKKLISHMKDGAYLVNTARGAICVAEDVAEAVKSGKLAGYGGDVWDKQPAPKDHPWRTMDNKDHVGNAMTVHISGTSLDAQKRYAQGVKNILNSYFSKKFDYRPQDIIVQNGSYATRAYGQKK

SEQ ID NO: 178 - protein, 170 aa, Escherichia coli
  HpaC
MQLDEQRLRFRDAMASLSAAVNIITTEGDAGQCGITATAVCSVTDTPPSLMVCINANSAMNPVFQGNGKLCVNVLNHEQELMARHFAGMTGMAMEERFSLSCWQKGPLAQPVLKGSLASLEGEIRDVQAIGTHLVYLVEIKNIILSAEGHGLIYFKRRFHPVMLEMEAAI

SEQ ID NO: 179 - protein, 476 aa, Bacillus megaterium
  GDH
MIKAKVSLRPIVSKINLPTVLKTAILPGDSFESLFIATQVGEIFYIRDEAIQTFLDIRSRIIKLGTSEPGVSRGGYDERGLLGLAFHPEFYYNGLFYLHYSAAGTQGPGALSEHYRPNPCDPKTSNLRWINRETKYDHIDTVEEWVFQPNAQPQKRRTLLNLRRPFFNHNGVNSLNFSPETGKLIFTTGDGGSGYDPFNLSQDDIEIYGKIIEIDVGKNTFIHNPPVVTRFSELPSPIQETLTLIAKGVRNITGISFQKFYNQYIKYVGNVGQDVVESIFSFVHYKPIPVPQLVQASLMRAKPSQEGFINLGWRGWEGDFPTSFIKRCSENPALDEKIIAYYNEAVKTSVRRIQPLTSYFHKDPRPNKFGGTSLTGVQPYMGNKISSLTGSVMFTDIAQVKEPQSPIRGVLAYTRAGTDCKLNDFSVVEVDYNFGSQSAYYVSLGTNLDQTRLYLGVYGSMKVSDFNQGTVFEIVP

SEQ ID NO: 180 - protein, 289 aa, Pseudomonas stutzeri
  PTDH
MLNPVWLKSLVAIVQTGSFQSAARALGLAQPTVSQHLQKLEEQVGVTLVQRSRSGCQPTTRALAFMPHATALLDMHARALEALHGNRERVGASSNIGTYLLQPFVRNYLTTANERGEVDLRIAANPDVADQLLAGQLDAAIMEWWLPHPDFEHRLWRVEPLVLIVSPDHALAEAGCIERDRLVDLPMLGGEPGSGTGRLLTEYFGELGVPRSGMQLGSTEAVKQAVRAGLGVSLVMASAVQDEVRSGALVALPIPGLEKRLQLIWRKPPGNLHPPGFVRHLLEEADLAG

SEQ ID NO: 181 - protein, 486 aa, Leuconostoc mesenteroides
  G6PDH
MVSEIKTLVTFFGGTGDLAKRKLYPSVFNLYKKGYLQEHFAIVGTARQQLSDDEFKQLVRDSIKDFTEDQAQAEAFIAHFSYRAHDVTDAASYGILKSAIEEAATKFDIDGNRIFYMSVAPRFFGTIAKYLKSEGLLAETGYNRLMIEKPFGTSYATAEELQSDLENAFDDDQLFRIDHYLGKEMVQNIAALRFGNPIFDAAWNKDYIKNVQVTLAEVLGVEERAGYYDTTGALLDMIQNHTMQIVGWLAMEKPESFNDKDIRAAKNAAFNALKIYNEEEVNKYFVRAQYGAGDTADYKPYLEEADVPADSKNNTFIAGELQFDLPRWEGVPFYVRSGKRLAAKQTRVDIVFKAGTFNFGSEQEAQESVLSIIIDPKGAIELKLNAKSVEDAFNTRTINLDWAVSDEDKKNTPEPYERMIHDTMNGDGSNFADWNGVSIAWKFVDAITAVYDADKAPLETYKSGSMGPEASDKLLAENGDAWVFKG

SEQ ID NO: 182 - protein, 348 aa, Saccharomyces cerevisiae
  ADH2
MSIPETQKAIIFYESNGKLEHKDIPVPKPKPNELLINVKYSGVCHTDLHAWHGDWPLPTKLPLVGGHEGAGVVVGMGENVKGWKIGDYAGIKWLNGSCMACEYCELGNESNCPHADLSGYTHDGSFQEYATADAVQAAHIPQGTDLAEVAPILCAGITVYKALKSANLRAGHWAAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 183 - protein, 237 aa, Mesembryanthemum crystallinum
  McPFOMT
MDFAVMKQVKNTGLLQSEELCQYILRTSVYPREAGFLKELREANESHPDSYMSTSPLAGQLMSFVLKLVNAKKTIEVGVFTGYSLLLTALSIPDDGKITAIDFDREAYEIGLPFIRKAGVEHKINFIESDAMLALDNLLQGQESEGSYDFGFVDADKPNYIKYHERLMKLVKVGGIVAYDNTLWGGTVAQPESEVPDFMKENREAVIELNKLLAADPRIEIVHLPLGDGITFCRRLY

SEQ ID NO: 184 - protein, 363 aa, Arabidopsis thaliana
  (AtCOMT)
MGSTAETQLTPVQVTDDEAALFAMQLASASVLPMALKSALELDLLEIMAKNGSPMSPTEIASKLPTKNPEAPVMLDRILRLLTSYSVLTCSNRKLSGDGVERIYGLGPVCKYLTKNEDGVSIAALCLMNQDKVLMESWYHLKDAILDGGIPFNKAYGMSAFEYHGTDPRFNKVFNNGMSNHSTITMKKILETYKGFEGLTSLVDVGGGIGATLKMIVSKYPNLKGINFDLPHVIEDAPSHPGIEHVGGDMFVSVPKGDAIFMKWICHDWSDEHCVKFLKNCYESLPEDGKVILAECILPETPDSSLSTKQVVHVDCIMLAHNPGGKERTEKEFEALAKASGFKGIKVVCDAFGVNLIELLKKL

SEQ ID NO: 185 - protein, 368 aa, Clarkia breweri
  IEMT1
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLTATDKVLLEPWFYLKDAILEGGIPFNKAYGMNEFDYHGTDHRFNKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

SEQ ID NO: 186 - protein, 384 aa, Saccharomyces cerevisiae
  ScSAMS
MSKSKTFLFTSESVGEGHPDKICDQVSDAILDACLEQDPFSKVACETAAKTGMIMVFGEITTKARLDYQQIVRDTIKKIGYDDSAKGFDYKTCNVLVAIEQQSPDIAQGLHYEKSLEDLGAGDQGIMFGYATDETPEGLPLTILLAHKLNMAMADARRDGSLPWLRPDTKTQVTVEYEDDNGRWVPKRIDTVVISAQHADEISTADLRTQLQKDIVEKVIPKDMLDENTKYFIQPSGRFVIGGPQGDAGLTGRKIIVDAYGGASSVGGGAFSGKDYSKVDRSAAYAARWVAKSLVAAGLCKRVQVQFSYAIGIAEPLSLHVDTYGTATKSDDEIIEIIKKNFDLRPGVLVKELDLARPIYLPTASYGHFTNQEYSWEKPKKLEF

SEQ ID NO: 187 - protein, 406 aa, Cryptosporidium parvum
  CpSAMS
MDSSRFSGNKSTYTDLQTTSEQFLFSSESVCSGHPDKLCDQISDAILDACLEQDPESFVACETCTKTGFIMVFGEITTKANVNYERVVRETVKEIGYDSEEKGLDYKTMDVIIKLEQQSNQIAGCVHVDKNVEDIGAGDQGMMFGYATNETKELMPLTHVLATSITRELDYIRVKGVSSRVGWLRPDGKAQVTVEYNCKHGVLIPKRIHTILVSVQHDENIENEEIREFVLENVIKKVCPSDLMDKETRILINPSGRFTIGGPAADAGLTGRKIIVDTYGGWGAHGGGAFSGKDATKVDRSGAYMARLVAKSIVFSGLCSRCLVQVSYGIGIARPLSLYINTFGTAKDGYNDAKLLEIVNKVFDFRPGILIKQLNLKSPIFKKTSSGGHFGRSEEEFLWEKPIILQ

SEQ ID NO: 188 - protein, 392 aa, Leishmania donovani
  LdSAMS
MSVHSILFSSEHVTEGHPDKLCDQVSDAVLDACLAGDPFSKVACESCAKTGMVMVFGEITTKAVLDYQKIVRNTIKDIGFDSADKGLDYESCNVLVAIEQQSPDICQGLGNFDSEDLGAGDQGMMFGYATDETETLMPLTYELARGLAKKYSELRRSGSLEWARPDAKTQVTVEYDYDTREGKQVLTPKRVAVVLISAQHDEHVTNDKISVDLMEKVIKAVIPANMLDAETKYWLNPSGRFVRGGPHGDAGLTGRKIIVDTYGGWGAHGGGAFSGKDPSKVDRSAAYAARWIAKSIVAGGLARRCLVQLAYAIGVAEPLSMHVETYGTGKYDDAKLLEIVKQNFKLRPYDIIQELNLRRPIYYDTSRFGHFGRKDELGTGGFTWEVPKKMVE

SEQ ID NO: 189 - protein, 399 aa, Mycobacterium smegmatis
  MsSAMS
MSKGRLFTSESVTEGHPDKICDAISDSVLDALLEQDPKSRVAVETLVTTGQVHVAGEVTTTAYADIPKIVRDRILDIGYDSSTKGFDGASCGVNVAIGAQSPDIAQGVDTAHETRVEGKADPLDLQGAGDQGLMFGYAIGDTPELMPLPIALAHRLARRLTEVRKNGVLDYLRPDGKTQVTIQYDGTTPVRLDTVVLSTQHADGIDLEGTLTPDIREKVVNTVLADLGHETLDTSDYRLLVNPTGKFVLGGPMGDAGLTGRKIIVDTYGGWARHGGGAFSGKDPSKVDRSAAYAMRWVAKNVVAAGLAERVEVQVAYAIGKAAPVGLFVETFGSETVDPAKIEKAIGEVFDLRPAAIVRDLDLLRPIYAPTAAYGHFGRTDIELPWEQTNKVDDLKSAI

SEQ ID NO: 190 - protein, 396 aa, Bos Taurus
  BtSAMS
MNGPVDGLCDHSLSEEGAFMFTSESVGEGHPDKICDQISDAVLDAHLKQDPNAKVACETVCKTGMVLLCGEITSMAMVDYQRVVRETIQHIGYDDSAKGFDFKTCNVLVALEQQSPDIAQCVHLDRNEEDVGAGDQGLMFGYATDETEECMPLTIMLAHRLNARMAELRRSGQLPWLQPDSKTQVTVQYTQDNGAVIPMRVHTVVISVQHNEDITLEDMRRALKEQVIRAVVPARYLDEDTIYHLQPSGRFVIGGPQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVNKNFDLRPGVIVRDLDLKKPIYQKTACYGHFGRSEFPWEVPKKLVF

SEQ ID NO: 191 - protein, 1049 aa, Bacillus megaterium
  A75G F88V L189Q R472C
MTIKEMPQPKTFGELKNLPLLNTDKPVQALMKIADELGEIFKFEAPGRVTRYLSSQRLIKEACDESRFDKNLSQGLKFVRDFAGDGLVTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKQQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVCKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 192 - protein, 1049 aa, Bacillus megaterium
  A75G/ F88V/L189Q/A331S/R472C
MTIKEMPQPKTFGELKNLPLLNTDKPVQALMKIADELGEIFKFEAPGRVTRYLSSQRLIKEACDESRFDKNLSQGLKFVRDFAGDGLVTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKQQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPSFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVCKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDSAADMPLAKMHGAFSTNVVASKELQQPGSARSTRHLEIELPKEASYQEGDHLGVIPRNYEGIVNRVTARFGLDASQQIRLEAEEEKLAHLPLAKTVSVEELLQYVELQDPVTRTQLRAMAAKTVCPPHKVELEALLEKQAYKEQVLAKRLTMLELLEKYPACEMKFSEFIALLPSIRPRYYSISSSPRVDEKQASITVSVVSGEAWSGYGEYKGIASNYLAELQEGDTITCFISTPQSEFTLPKDPETPLIMVGPGTGVAPFRGFVQARKQLKEQGQSLGEAHLYFGCRSPHEDYLYQEELENAQSEGIITLHTAFSRMPNQPKTYVQHVMEQDGKKLIELLDQGAHFYICGDGSQMAPAVEATLMKSYADVHQVSEADARLWLQQLEEKGRYAKDVWAG

SEQ ID NO: 193 - DNA, 1077 bp, Glycine max
  (GmSOMT)
atggcgtcaccgttgaataatggccgcaaagccagtgagattttccagggtcaagcgttgctgtacaaacatcttttagggtttatcgacagcaaatgtctgaaatggatggtggagctggatattccggatatcattcactcccatagccatggacagcctattaccttctctgaattggtttcgatcctgcaagttcctccgaccaaaacacgtcaggttcagtcgttgatgcgctatcttgcgcataatggtttctttgaaattgtgcgcattcacgataacatcgaagcctatgcgttaactgctgccagtgaactgcttgtgaaaagctcggaattatccttagcaccaatggtggagtattttctggaaccgaattgtcagggtgcgtggaatcagctgaaacgttgggtacatgaagaggatctgacggtctttggtgtatctctgggcactccattctgggatttcatcaacaaagacccagcatataacaagtcctttaacgaagctatggcatgtgatagccaaatgctcaatctggcgtttcgcgattgcaattgggtctttgaaggcctggaatcgattgtggatgtgggcggtggtacgggcattacagccaaaatcatttgcgaagcatttccgaagttgaaatgcatggtactcgaacgtcccaacgtagtggagaacctgtcaggcagcaacaatctgacctttgttggtggggacatgttcaaatgcattccgaaagcggatgcggtgcttctgaaactggttctgcacaattggaacgacaatgactgcatgaagatcctggaaaactgcaaggaagccatttcaggagagagtaaaaccggcaaagtcgtcgttattgacaccgtgattaacgagaacaaagacgaacgccaagttaccgaactgaaactcctgatggatgtccacatggcctgtatcatcaacggcaaagagcggaaagaagaggattggaagaaactgttcatggaagctgggttccagtcttacaagattagcccctttacgggctacttaagtctcatcgaaatctatccgtaa

SEQ ID NO: 194 - DNA, 663 bp, Myxococcus xanthus
  (MxSafC)
atgatccaccacgtcgaattgacacagtccgtcctgcagtacatccgcgacagttccgtgagggacaacgacatccttcgcgacctgcgagaggagacgtcgaagctccccctgcgcacgatgcagattcctcccgagcaggggcagctcctgagcctgctggtgcgcctcatcggcgcgcgcaagacgctcgaggtgggcgtcttcaccggctatagcaccctgtgtgccgcgctcgcgctgcccgccgatgggcgcgtcatcgcgtgcgacctgagcgaggagtgggtctccatcgcgcgccgctactggcagcgggcgggcgtggcggatcgcatcgaggtccggcttggcgacgcccaccattccctggaggcgctggtcggcagcgagcaccgcgggacgttcgacctcgcgttcatcgatgcggacaaggagagctacgacttctactacgagcacgcgctgcggctggtgcgtcccggcgggttgatcatcctcgacaacacgctgtggtccgggaaggtcgccgacccgagcgtcgtcggggacccggagacggactcgctgcggcgcatcaacgccaagctcctgactgacgaacgggtggacctcagcatgctcccaatcgctgacggactgaccctcgctcgcaagcgctag

SEQ ID NO: 195 - DNA, 1107 bp, Clarkia breweri
  (CbMOMT)
atgggttcgacaggcaatgcggaaattcagatcattccgacacatagctccgacgaagaagcgaatttgtttgcgatgcaactggcctcagctgcggttctgcccatggcgctgaaagccgcgattgagcttgatgtgttagagattatggccaaatccgtaccaccaagcggctatatttcaccggccgaaattgctgctcaactcccgacgactaatccggaagcaccggtcatgttggatcgcgttttgcggttactggcgagctattcggtagtgacgtataccctgcgtgagctgccgtctggcaaagtcgaacgtctgtacggactggcgccggtgtgcaaattcctgactaagaatgaggatggggtttctctcgcaccctttctgctccttgcgacggataaagtcctgctggaaccatggttctacctgaaagacgccattctggaaggcggcattccgttcaacaaggcatacggaatgaacatcttcgattactttggcactgatcaccgcatcaacaaagtattcaacaaagggatgtctagcaatagtaccatcaccatgaagaaaattctggagatgtacaatgggtttgaaggcctgaccaccatcgtggatgttggtggtggtacaggcgcagttgcctccatgattgtggcgaaatatccgtcgatcaatgccattaactttgacttaccccatgtcattcaggatgcgcctgcgtttagcggtgttgaacacttaggtggggacatgtttgacggtgtgccaaaaggcgatgcgatctttatcaaatggatctgtcatgactggagcgatgaacactgtctgaaacttcttaagaactgctatgctgccttgccggatcatggcaaagtgatcgttgccgaatacattctgcctccgtcgcctgatccgagtattgcaaccaaagtagtcatccataccgacgctctgatgctcgcctataaccctggtggaaaagagcgtacggagaaagaattccaggcattagcaatggcgagtggctttcgcggttttaaggtggcatcatgcgctttcaacacctatgtgatggaattcctgaaaacggcctaa

SEQ ID NO: 196 - DNA, 1107 bp, Clarkia breweri
  (CbMOMT-L322N)
atgggttcgacaggcaatgcggaaattcagatcattccgacacatagctccgacgaagaagcgaatttgtttgcgatgcaactggcctcagctgcggttctgcccatggcgctgaaagccgcgattgagcttgatgtgttagagattatggccaaatccgtaccaccaagcggctatatttcaccggccgaaattgctgctcaactcccgacgactaatccggaagcaccggtcatgttggatcgcgttttgcggttactggcgagctattcggtagtgacgtataccctgcgtgagctgccgtctggcaaagtcgaacgtctgtacggactggcgccggtgtgcaaattcctgactaagaatgaggatggggtttctctcgcaccctttctgctccttgcgacggataaagtcctgctggaaccatggttctacctgaaagacgccattctggaaggcggcattccgttcaacaaggcatacggaatgaacatcttcgattactttggcactgatcaccgcatcaacaaagtattcaacaaagggatgtctagcaatagtaccatcaccatgaagaaaattctggagatgtacaatgggtttgaaggcctgaccaccatcgtggatgttggtggtggtacaggcgcagttgcctccatgattgtggcgaaatatccgtcgatcaatgccattaactttgacttaccccatgtcattcaggatgcgcctgcgtttagcggtgttgaacacttaggtggggacatgtttgacggtgtgccaaaaggcgatgcgatctttatcaaatggatctgtcatgactggagcgatgaacactgtctgaaacttcttaagaactgctatgctgccttgccggatcatggcaaagtgatcgttgccgaatacattctgcctccgtcgcctgatccgagtattgcaaccaaagtagtcatccataccgacgctaacatgctcgcctataaccctggtggaaaagagcgtacggagaaagaattccaggcattagcaatggcgagtggctttcgcggttttaaggtggcatcatgcgctttcaacacctatgtgatggaattcctgaaaacggcctaa

SEQ ID NO: 197 - DNA, 1107 bp, Clarkia breweri
  (CbMOMT-T133S)
atgggttcgacaggcaatgcggaaattcagatcattccgacacatagctccgacgaagaagcgaatttgtttgcgatgcaactggcctcagctgcggttctgcccatggcgctgaaagccgcgattgagcttgatgtgttagagattatggccaaatccgtaccaccaagcggctatatttcaccggccgaaattgctgctcaactcccgacgactaatccggaagcaccggtcatgttggatcgcgttttgcggttactggcgagctattcggtagtgacgtataccctgcgtgagctgccgtctggcaaagtcgaacgtctgtacggactggcgccggtgtgcaaattcctgactaagaatgaggatggggtttctctcgcaccctttctgctctcggcgacggataaagtcctgctggaaccatggttctacctgaaagacgccattctggaaggcggcattccgttcaacaaggcatacggaatgaacatcttcgattactttggcactgatcaccgcatcaacaaagtattcaacaaagggatgtctagcaatagtaccatcaccatgaagaaaattctggagatgtacaatgggtttgaaggcctgaccaccatcgtggatgttggtggtggtacaggcgcagttgcctccatgattgtggcgaaatatccgtcgatcaatgccattaactttgacttaccccatgtcattcaggatgcgcctgcgtttagcggtgttgaacacttaggtggggacatgtttgacggtgtgccaaaaggcgatgcgatctttatcaaatggatctgtcatgactggagcgatgaacactgtctgaaacttcttaagaactgctatgctgccttgccggatcatggcaaagtgatcgttgccgaatacattctgcctccgtcgcctgatccgagtattgcaaccaaagtagtcatccataccgacgctctgatgctcgcctataaccctggtggaaaagagcgtacggagaaagaattccaggcattagcaatggcgagtggctttcgcggttttaaggtggcatcatgcgctttcaacacctatgtgatggaattcctgaaaacggcctaa

SEQ ID NO: 198 - protein, 358 aa, Glycine max
  (GmSOMT)
MASPLNNGRKASEIFQGQALLYKHLLGFIDSKCLKWMVELDIPDIIHSHSHGQPITFSELVSILQVPPTKTRQVQSLMRYLAHNGFFEIVRIHDNIEAYALTAASELLVKSSELSLAPMVEYFLEPNCQGAWNQLKRWVHEEDLTVFGVSLGTPFWDFINKDPAYNKSFNEAMACDSQMLNLAFRDCNWVFEGLESIVDVGGGTGITAKIICEAFPKLKCMVLERPNVVENLSGSNNLTFVGGDMFKCIPKADAVLLKLVLHNWNDNDCMKILENCKEAISGESKTGKVVVIDTVINENKDERQVTELKLLMDVHMACIINGKERKEEDWKKLFMEAGFQSYKISPFTGYLSLIEIYP

SEQ ID NO: 199 - protein, 220 aa, Myxococcus xanthus
  (MxSafC)
MIHHVELTQSVLQYIRDSSVRDNDILRDLREETSKLPLRTMQIPPEQGQLLSLLVRLIGARKTLEVGVFTGYSTLCAALALPADGRVIACDLSEEWVSIARRYWQRAGVADRIEVRLGDAHHSLEALVGSEHRGTFDLAFIDADKESYDFYYEHALRLVRPGGLIILDNTLWSGKVADPSVVGDPETDSLRRINAKLLTDERVDLSMLPIADGLTLARKR

SEQ ID NO: 200 - protein, 368 aa, Clarkia breweri
  (CbMOMT)
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLLATDKVLLEPWFYLKDAILEGGIPFNKAYGMNIFDYFGTDHRINKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

SEQ ID NO: 201 - protein, 368 aa, Clarkia breweri
  (CbMOMT-L322N)
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLLATDKVLLEPWFYLKDAILEGGIPFNKAYGMNIFDYFGTDHRINKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDANMLAYNPGGKERTEKEFQALAMASGFRGFKVASCAFNTYVMEFLKTA

SEQ ID NO: 202 - protein, 368 aa, Clarkia breweri
  (CbMOMT4-T133S)
MGSTGNAEIQIIPTHSSDEEANLFAMQLASAAVLPMALKAAIELDVLEIMAKSVPPSGYISPAEIAAQLPTTNPEAPVMLDRVLRLLASYSVVTYTLRELPSGKVERLYGLAPVCKFLTKNEDGVSLAPFLLSATDKVLLEPWFYLKDAILEGGIPFNKAYGMNIFDYFGTDHRINKVFNKGMSSNSTITMKKILEMYNGFEGLTTIVDVGGGTGAVASMIVAKYPSINAINFDLPHVIQDAPAFSGVEHLGGDMFDGVPKGDAIFIKWICHDWSDEHCLKLLKNCYAALPDHGKVIVAEYILPPSPDPSIATKVVIHTDALMLAYNPGGKERTEKEFQALAMASGFRGFKVASCAFNTYVMEFLKTA

The invention claimed is:

1. A method for catalyzing the biotechnological conversion of at least one 4-hydroxyphenyl compound for producing at least one 3,4-dihydroxyphenol compound comprising:
   (i) providing a mutant 4-hydroxyphenylacetate 3-hydroxylase or a catalytically active fragment thereof, comprising at least one mutation in an active site; wherein the sequence of wild-type 4-hydroxyphenylacetate 3-hydroxylase is set forth in SEQ ID NO: 98, in which the active site comprises residues I157, M293, Y301, and S462; wherein the sequence of the mutant 4-hydroxyphenylacetate 3-hydroxylase is at least 90% identical to SEQ ID NO: 98, and wherein the at least one mutation in the mutant active site comprises Y301F relative to the wild-type active site;
   (ii) providing at least one 4-hydroxyphenyl compound;
   (iii) reacting the at least one 4-hydroxyphenyl compound and the mutant 4-hydroxyphenylacetate 3-hydroxylase or the catalytically active fragment thereof under suitable reaction conditions for allowing the hydroxylation of the at least one 4-hydroxyphenyl compound by the mutant 4-hydroxyphenylacetate-3-hydroxylase or the catalytically active fragment thereof to yield at least one 3,4-dihydroxyphenol compound; and
   (iv) optionally isolating and/or purifying the resulting at least one 3,4-dihydroxyphenol compound.

2. The method according to claim 1, wherein the method is performed as a whole-cell approach, and wherein (i) is performed as follows:
   (a1) providing at least one recombinant host cell comprising the mutant 4-hydroxyphenylacetate 3-hydroxylase or the catalytically active fragment thereof, or comprising at least one recombinant nucleic acid molecule encoding the mutant 4-hydroxyphenylacetate 3-hydroxylase or the catalytically active fragment thereof;
   (b1) optionally, providing at least one recombinant host cell comprising at least one cofactor recycling enzyme or a catalytically active fragment thereof, or comprising at least one recombinant nucleic acid molecule encoding the at least one cofactor recycling enzyme or the catalytically active fragment thereof, wherein the at least one cofactor recycling enzyme is selected from the group consisting of:
   a flavin reductase; and,
   a formate dehydrogenase, and
   (c1) cultivating said at least one recombinant host cell under suitable reaction conditions allowing the functional expression and/or catalytic activity of the mutant 4-hydroxyphenylacetate 3-hydroxylase.

3. The method according to claim 1, wherein the method is performed in a cell-free in vitro system, and wherein (i) is performed as follows:
   (a2) providing the mutant 4-hydroxyphenylacetate 3-hydroxylase or the catalytically active fragment thereof; and
   (b2) optionally, providing at least one cofactor recycling enzyme or a catalytically active fragment thereof, wherein the at least one cofactor recycling enzyme is a flavin reductase or a formate dehydrogenase.

4. The method according to claim 1, wherein the biotechnological conversion of the at least one 4-hydroxyphenyl compound for producing at least one 3,4-dihydroxyphenol compound is performed as a continuous flow process.

5. The method according to claim 1, wherein the biotechnological conversion of the at least one 4-hydroxyphenyl compound for producing at least one 3,4-dihydroxyphenol compound is performed as a batch process.

6. The method according to claim 1, wherein the mutant 4-hydroxyphenylacetate 3-hydroxylase is encoded by a nucleic acid.

7. The method according to claim 1, wherein the hydroxylation in (iii) is catalyzed by the mutant 4-hydroxyphenylacetate 3-hydroxylase or the catalytically active fragment thereof under suitable reaction conditions to provide suitable regio- and product specificity so that there is essentially no further conversion of the resulting at least one 3,4-dihydroxyphenol compound.

8. The method according to claim 1, wherein the at least one 4-hydroxyphenyl compound is independently selected from the group consisting of naringenin, phloretin, p-coumaric acid, ferulic acid, resveratrol, p-hydroxybenzoic acid, 2-hydroxycarbazole, umbelliferone, rheosmin, enantiomers thereof, and precursors or derivatives thereof.

9. The method according to claim 6, wherein the sequence of the nucleic acid is set forth in SEQ ID NO: 44.

10. The method according to claim 1, wherein the sequence of the mutant 4-hydroxyphenylacetate 3-hydroxylase consists of SEQ ID NO: 98 with the Y301F mutation in the active site.

* * * * *